(12) United States Patent
Throsby et al.

(10) Patent No.: US 7,960,518 B2
(45) Date of Patent: Jun. 14, 2011

(54) HUMAN BINDING MOLECULES HAVING KILLING ACTIVITY AGAINST ENTEROCOCCI AND USES THEREOF

(75) Inventors: Mark Throsby, Utrecht (NL); Robert Arjen Kramer, Utrecht (NL); Cornelis Adriaan De Kruif, De Bilt (NL)

(73) Assignee: Crucell Holland B.V., Leiden (NL)

( * ) Notice: Subject to any disclaimer, the term of this patent is extended or adjusted under 35 U.S.C. 154(b) by 0 days.

(21) Appl. No.: 12/227,116

(22) PCT Filed: Jun. 5, 2007

(86) PCT No.: PCT/EP2007/055535
§ 371 (c)(1),
(2), (4) Date: Nov. 7, 2007

(87) PCT Pub. No.: WO2007/141278
PCT Pub. Date: Dec. 13, 2007

(65) Prior Publication Data
US 2009/0169562 A1    Jul. 2, 2009

Related U.S. Application Data

(60) Provisional application No. 60/811,542, filed on Jun. 6, 2006.

(30) Foreign Application Priority Data

| Jun. 6, 2006 | (EP) | 06115013 |
| Jul. 6, 2006 | (EP) | 06116719 |
| Sep. 26, 2006 | (EP) | 06121258 |
| Mar. 6, 2007 | (EP) | 07103587 |

(51) Int. Cl.
C07K 16/00    (2006.01)
C12P 21/08    (2006.01)

(52) U.S. Cl. .............. 530/388.2; 530/391.1; 436/548; 435/70.21

(58) Field of Classification Search .................. None
See application file for complete search history.

(56) References Cited

U.S. PATENT DOCUMENTS

| 5,696,108 A | 12/1997 | Heath, Jr. et al. |
| 6,265,150 B1 | 7/2001 | Terstappen et al. |
| 6,908,994 B1 | 6/2005 | Rich et al. |
| 7,244,430 B2 | 7/2007 | Throsby et al. |
| 7,537,764 B2 | 5/2009 | Throsby et al. |

| 2005/0180986 A1 | 8/2005 | Rich et al. |
| 2006/0002939 A1 | 1/2006 | Fischer et al. |
| 2009/0104204 A1 | 4/2009 | Throsby et al. |

FOREIGN PATENT DOCUMENTS

| WO | WO 84/03564 | 9/1984 |
| WO | WO 93/09872 | 5/1993 |
| WO | WO 98/15833 | 4/1998 |
| WO | WO 98/57994 | 12/1998 |
| WO | WO 99/18996 | 4/1999 |
| WO | WO 00/63403 | 10/2000 |
| WO | WO 02/103012 A1 | 12/2002 |
| WO | WO 03/059259 A2 | 7/2003 |
| WO | WO 03/059260 A | 7/2003 |
| WO | WO 03/072607 | 9/2003 |
| WO | WO 2004/043405 | 5/2004 |
| WO | WO 2005/103084 A2 | 11/2005 |
| WO | WO 2005-118644 A2 | 12/2005 |
| WO | WO 2006/067122 A2 | 6/2006 |
| WO | WO 2007/141278 A2 | 12/2007 |

OTHER PUBLICATIONS

Campbell, Monoclonal Antibody Technology, Elsevier Science Publishing Co., 1984, Chapter 1, pp. 1-32.*
van der Woude, Clinical Microbiology Reviews, 17(3):581-611, Jul. 2004.*
Chen et al (The EMBO Journal, 14(12:2784-2794, 1995).*
Kussie et al, (J. Immunology, 152:146-152, 1994).*
Dorland's Medical Dictionary for Healthcare Consumers; definition of infection one page (http://www.mercksource.com/pp/us/cns/cns_hl_dorlands_split.jsp?pg=/ppdocs/us/common/dorlands/dorland/four/000053439.htm).*
Stedman's Online Medical Dictionary , definition of infection one page.*
PCT International Search Report, PCT/EP2007/055535, dated Jun. 5, 2007.
Bowie et al., Science, 1990, pp. 1306-1310, vol. 247.
Cruse et al., Illustrated Dict. of Immunology, 2$^{nd}$ ed., CRC Press, 2003, p. 46.
Brown et al., J. Immunol., 1996, pp. 3285-3291, vol. 156.
Kussie et al., J. Immunol., 1994, pp. 146-152, vol. 152.
PCT International Search Report, PCT/EP2007/055527, dated Jan. 29, 2008.

* cited by examiner

*Primary Examiner* — Patricia A Duffy
(74) *Attorney, Agent, or Firm* — TraskBritt, P.C.

(57) ABSTRACT

The present invention provides human binding molecules specifically binding to enterococci and having killing activity against enterococci, nucleic acid molecules encoding the human binding molecules, compositions comprising the human binding molecules and methods of identifying or producing the human binding molecules. The human binding molecules can be used in the diagnosis, prophylaxis and/or treatment of a condition resulting from *Enterococcus*.

11 Claims, 1 Drawing Sheet

US 7,960,518 B2

HUMAN BINDING MOLECULES HAVING KILLING ACTIVITY AGAINST ENTEROCOCCI AND USES THEREOF

CROSS-REFERENCE TO RELATED APPLICATION(S)

This application is the national phase entry of PCT International Patent Application No. PCT/EP2007/055535, filed on Jun. 5, 2007, designating the United States of America, and published, in English, as PCT International Publication No. WO 2007/141278 A2 on Dec. 13, 2007, which itself claims the benefit of U.S. Provisional Patent Application Ser. No. 60/811,542, filed Jun. 6, 2006, EP 06115013.2, filed Jun. 6, 2006, EP 06116719.2, filed Jul. 6, 2006, EP 06121258.5, filed on Sep. 26, 2006, and EP 07103587.7 filed on Mar. 6, 2007.

STATEMENT ACCORDING TO 37 C.F.R. §1.52(e)(5)

SEQUENCE LISTING SUBMITTED ON COMPACT DISC

Pursuant to 37 C.F.R. §1.52(e)(1)(ii), a compact disc containing an electronic version of the Sequence Listing has been submitted concomitant with this application, the contents of which are hereby incorporated by reference. A second compact disc is submitted and is an identical copy of the first compact disc. The discs are labeled "copy 1" and "copy 2," respectively, and each disc contains one file entitled "seq listing.txt" which is 810 KB and created on Nov. 7, 2008.

FIELD OF THE INVENTION

The invention relates to medicine. In particular the invention relates to the diagnosis, prophylaxis and/or treatment of infection by enterococci.

BACKGROUND OF THE INVENTION

Enterococci are gram-positive, facultatively anaerobic bacteria of the family Enterococcaceae. They were previously classified as Group D streptococci. Enterococci are found in the bowels of most humans and are commonly isolated from stool, urine and sites of intra-abdominal and lower extremity infection. Bacteria of the genus *Enterococcus* are often regarded as harmless commensals of the gastrointestinal tract, but within the last 10 years they have become an important cause of nosocomial (hospital-acquired) infections, not because of increased virulence but because of antibiotic resistance. It has been estimated in the United States of America, that 800,000 cases of enterococcal infection occur each year resulting in costs of around $500 million. To infect hosts enterococci primarily colonize mucosal surfaces. Enterococci are aetiological agents of bacteraemia, surgical wound infections, urinary tract infections, and endocarditis. They are also associated with obligate anaerobes in mixed infections that result in intra-abdominal abscesses. Overall, there are about seventeen species of enterococci, among which *Enterococcus faecalis* and *Enterococcus faecium* appear to be the most commonly detected in human faeces. *E. faecalis* accounts for most of the enterococcal infections of humans, usually representing 80-90% of clinical isolates. *E. faecium* is detected much less frequently but is nevertheless of significance because of a high incidence of multiple resistances to antibacterial agents. Enterococcal infections are commonly treated with antimicrobials and until recently they have been adequately controlled using these agents. However, drug-resistant enterococcal strains are emerging, and infection by strains resistant to all presently available antibiotics may become a serious problem in the near future. Some enterococci have already acquired intrinsic resistance to β-lactam-based antibiotics (penicillins) as well as many aminoglycosides. In the last two decades, particularly virulent strains of *Enterococcus* which are even resistant to the antibiotic vancomycin (Vancomycin-Resistant *Enterococcus*, or VRE) have emerged in nosocomial infections of hospitalized patients. Despite the urgent need for the development of new antibiotics, the major pharmaceutical companies appear to have lost interest in the antibiotic market. In 2002, only 5 out of the more than 500 drugs in phase II or phase III clinical development were new antibiotics. In the last 6 years only 10 antibiotics have been registered and only 2 of those did not exhibit cross-reactivity with existing drugs (and thus not subject to the same patterns of drug resistance). This trend has been attributed to several factors: the cost of new drug development and the relatively small return on investment that infectious disease treatments yield compared to drugs against hypertension, arthritis and lifestyle drugs e.g. for impotence. Another contributing factor is the increasing difficulty in finding new targets, further driving up development costs. Therefore, investigation into novel therapies or preventative measures for (multi-drug-resistant) bacterial infections is urgently needed to meet this impending healthcare crisis.

Active immunization with vaccines and passive immunization with immunoglobulins are promising alternatives to classical small molecule therapy. A few bacterial diseases that once caused widespread illness, disability, and death can now be prevented through the use of vaccines. The vaccines are based on weakened (attenuated) or dead bacteria, components of the bacterial surface or on inactivated toxins. The immune response raised by a vaccine is mainly directed to immunogenic structures, a limited number of proteins or sugar structures on the bacteria that are actively processed by the immune system. Since these immunogenic structures are very specific to the organism, the vaccine needs to comprise the immunogenic components of all variants of the bacteria against which the vaccine should be protective. As a consequence thereof, vaccines are very complex, take long and are expensive to develop.

Further complicating the design of vaccines is the phenomenon of 'antigen replacement'. This occurs when new strains become prevalent that are serologically and thus antigenically distinct from those strains covered by the vaccines. The immune status of the populations at risk for nosocomial infections further complicates vaccine design. These patients are inherently unwell and may even be immunocompromised (due to the effect of immunosuppressive drugs) resulting in delayed or insufficient immunity against the infecting pathogens. Furthermore, except in the case of certain elective procedures, it may not be possible to identify and vaccinate the at risk patients in time to give them sufficient immune protection from infection.

Direct administration of therapeutic immunoglobulins, also referred to as passive immunization, does not require an immune response from the patient and therefore gives immediate protection. In addition, passive immunization can be directed to bacterial structures that are not immunogenic and that are less specific to the organism. Passive immunization against pathogenic organisms has been based on immunoglobulins derived from sera of human or non-human donors. However, blood-derived products have potential health risks inherently associated with these products. In addition, the immunoglobulins can display batch-to-batch variation and may be of limited availability in case of sudden mass exposures. Recombinantly produced antibodies do not have these disadvantages and thus offer an opportunity to replace immunoglobulins derived from sera.

Murine monoclonal antibodies directed against enterococcal antigens are known in the art (see WO 03/072607). However, murine antibodies are limited for their use in vivo due to problems associated with administration of murine antibodies to humans, such as short serum half life, an inability to trigger certain human effector functions and elicitation of an unwanted dramatic immune response against the murine antibody in a human (HAMA).

WO 99/18996 relates to *enterococcus* antigens and vaccines. WO 99/18996 further discloses rabbit antiserum against conjugated purified antigens from enterococci, and opsonic activity of such antiserum.

Although WO 99/18996 refers to human antibodies as desired molecules, the antibodies actually disclosed and used therein are of rabbit origin, and this documents actually does not actually disclose any human antibodies, nor sequences thereof.

In view of their therapeutic benefit in humans, there is thus still a need for human monoclonal antibodies against enterococci.

In addition, a need exists in the art for human antibodies that can kill a broader range of bacteria, such as enterococci and staphylococci.

The present invention provides these antibodies and shows that they can be used in medicine, in particular for diagnosis, prevention and/or treatment of enterococcal infections.

DESCRIPTION OF THE INVENTION

Figure 1:
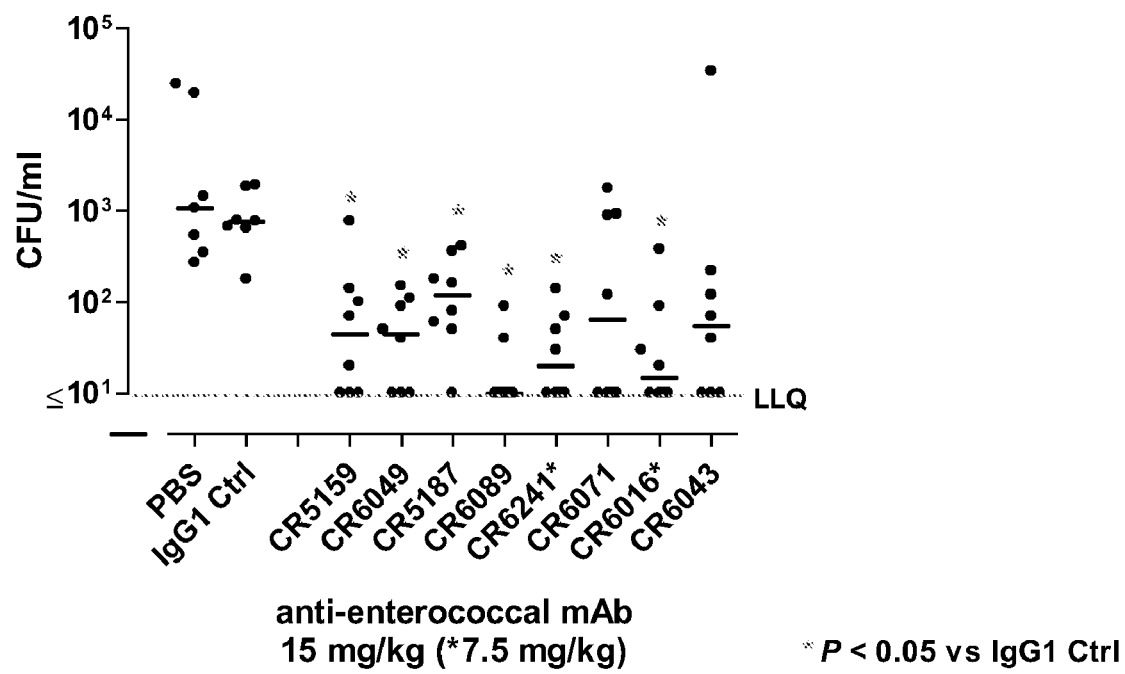
FIG. 1 shows data of an in vivo experiment. On the Y-axis CFU/ml in blood of mice is shown, while on the X-axis the respective antibodies are depicted. The antibodies were used in an amount of 15 mg/kg, with the exception of CR6016 and CR6241 which were used in an amount of 7.5 mg/kg. With the exception of CR6043 and CR6071 all of the antibodies had a median that differed significantly with that of the control IgG ($P<0.05$ vs IgG1 Ctrl.).

Here below follow definitions of terms as used in the invention.

Definitions

Amino Acid Sequence

The term "amino acid sequence" as used herein refers to naturally occurring or synthetic molecules and to a peptide, oligopeptide, polypeptide or protein sequence.

Binding Molecule

As used herein the term "binding molecule" refers to an intact immunoglobulin including monoclonal antibodies, such as chimeric, humanized or human monoclonal antibodies, or to an antigen-binding and/or variable domain comprising fragment of an immunoglobulin that competes with the intact immunoglobulin for specific binding to the binding partner of the immunoglobulin, e.g. enterococci. Regardless of structure, the antigen-binding fragment binds with the same antigen that is recognized by the intact immunoglobulin. An antigen-binding fragment can comprise a peptide or polypeptide comprising an amino acid sequence of at least 2 contiguous amino acid residues, at least 5 contiguous amino acid residues, at least 10 contiguous amino acid residues, at least 15 contiguous amino acid residues, at least 20 contiguous amino acid residues, at least 25 contiguous amino acid residues, at least 30 contiguous amino acid residues, at least 35 contiguous amino acid residues, at least 40 contiguous amino acid residues, at least 50 contiguous amino acid residues, at least 60 contiguous amino residues, at least 70 contiguous amino acid residues, at least 80 contiguous amino acid residues, at least 90 contiguous amino acid residues, at least 100 contiguous amino acid residues, at least 125 contiguous amino acid residues, at least 150 contiguous amino acid residues, at least 175 contiguous amino acid residues, at least 200 contiguous amino acid residues, or at least 250 contiguous amino acid residues of the amino acid sequence of the binding molecule.

The term "binding molecule", as used herein includes all immunoglobulin classes and subclasses known in the art. Depending on the amino acid sequence of the constant domain of their heavy chains, binding molecules can be divided into the five major classes of intact antibodies: IgA, IgD, IgE, IgG, and IgM, and several of these may be further divided into subclasses (isotypes), e.g., IgA1, IgA2, IgG1, IgG2, IgG3 and IgG4.

Antigen-binding fragments include, inter alia, Fab, F(ab'), F(ab')2, Fv, dAb, Fd, complementarity determining region (CDR) fragments, single-chain antibodies (scFv), bivalent single-chain antibodies, single-chain phage antibodies, diabodies, triabodies, tetrabodies, (poly)peptides that contain at least a fragment of an immunoglobulin that is sufficient to confer specific antigen binding to the (poly)peptide, etc. The above fragments may be produced synthetically or by enzymatic or chemical cleavage of intact immunoglobulins or they may be genetically engineered by recombinant DNA techniques.

The methods of production are well known in the art and are described, for example, in Antibodies: A Laboratory Manual, Edited by: E. Harlow and D, Lane (1988), Cold Spring Harbor Laboratory, Cold Spring Harbor, N.Y., which is incorporated herein by reference. A binding molecule or antigen-binding fragment thereof may have one or more binding sites. If there is more than one binding site, the binding sites may be identical to one another or they may be different.

The binding molecule can be a naked or unconjugated binding molecule but can also be part of an immunoconjugate. A naked or unconjugated binding molecule is intended to refer to a binding molecule that is not conjugated, operatively linked or otherwise physically or functionally associated with an effector moiety or tag, such as inter alia a toxic substance, a radioactive substance, a liposome, an enzyme. It will be understood that naked or unconjugated binding molecules do not exclude binding molecules that have been stabilized, multimerized, humanized or in any other way manipulated, other than by the attachment of an effector moiety or tag. Accordingly, all post-translationally modified naked and unconjugated binding molecules are included herewith, including where the modifications are made in the natural binding molecule-producing cell environment, by a recombinant binding molecule-producing cell, and are introduced by the hand of man after initial binding molecule preparation. Of course, the term naked or unconjugated binding molecule does not exclude the ability of the binding molecule to form functional associations with effector cells and/or molecules after administration to the body, as some of such interactions are necessary in order to exert a biological effect. The lack of associated effector group or tag is therefore applied in definition to the naked or unconjugated binding molecule in vitro, not in vivo.

Biological Sample

As used herein, the term "biological sample" encompasses a variety of sample types, including blood and other liquid samples of biological origin, solid tissue samples such as a biopsy specimen or tissue cultures, or cells derived therefrom and the progeny thereof. The term also includes samples that have been manipulated in any way after their procurement, such as by treatment with reagents, solubilization, or enrichment for certain components, such as proteins or polynucleotides. The term encompasses various kinds of clinical samples obtained from any species, and also includes cells in culture, cell supernatants and cell lysates.

Complementarity Determining Regions (CDR)

The term "complementarity determining regions" as used herein means sequences within the variable regions of binding molecules, such as immunoglobulins, that usually contribute to a large extent to the antigen binding site which is complementary in shape and charge distribution to the epitope recognized on the antigen. The CDR regions can be specific for linear epitopes, discontinuous epitopes, or conformational epitopes of proteins or protein fragments, either as present on the protein in its native conformation or, in some cases, as present on the proteins as denatured, e.g., by solubilization in SDS. Epitopes may also consist of posttranslational modifications of proteins.

Deletion

The term "deletion", as used herein, denotes a change in either amino acid or nucleotide sequence in which one or more amino acid or nucleotide residues, respectively, are absent as compared to the parent, often the naturally occurring, molecule.

Expression-Regulating Nucleic Acid Sequence

The term "expression-regulating nucleic acid sequence" as used herein refers to polynucleotide sequences necessary for and/or affecting the expression of an operably linked coding sequence in a particular host organism. The expression-regulating nucleic acid sequences, such as inter alia appropriate transcription initiation, termination, promoter, enhancer sequences; repressor or activator sequences; efficient RNA processing signals such as splicing and polyadenylation signals; sequences that stabilize cytoplasmic mRNA; sequences that enhance translation efficiency (e.g., ribosome binding sites); sequences that enhance protein stability; and when desired, sequences that enhance protein secretion, can be any nucleic acid sequence showing activity in the host organism of choice and can be derived from genes encoding proteins, which are either homologous or heterologous to the host organism. The identification and employment of expression-regulating sequences is routine to the person skilled in the art.

Functional Variant

The term "functional variant", as used herein, refers to a binding molecule that comprises a nucleotide and/or amino acid sequence that is altered by one or more nucleotides and/or amino acids compared to the nucleotide and/or amino acid sequences of the parental binding molecule and that is still capable of competing for binding to the binding partner, e.g. enterococci, with the parental binding molecule. In other words, the modifications in the amino acid and/or nucleotide sequence of the parental binding molecule do not significantly affect or alter the binding characteristics of the binding molecule encoded by the nucleotide sequence or containing the amino acid sequence, i.e. the binding molecule is still able to recognize and bind its target. The functional variant may have conservative sequence modifications including nucleotide and amino acid substitutions, additions and deletions. These modifications can be introduced by standard techniques known in the art, such as site-directed mutagenesis and random PCR-mediated mutagenesis, and may comprise natural as well as non-natural nucleotides and amino acids.

Conservative amino acid substitutions include the ones in which the amino acid residue is replaced with an amino acid residue having similar structural or chemical properties. Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., asparagine, glutamine, serine, threonine, tyrosine, cystiene, tryptophan), nonpolar side chains (e.g., glycine, alanine, valine, leucine, isoleucine, proline, phenylalanine, methionine), beta-branched side chains (e.g., threonine, valine, isoleucine) and aromatic side chains (e.g., tyrosine, phenylalanine, tryptophan). It will be clear to the skilled artisan that other classifications of amino acid residue families than the one used above can also be employed. Furthermore, a variant may have non-conservative amino acid substitutions, e.g., replacement of an amino acid with an amino acid residue having different structural or chemical properties. Similar minor variations may also include amino acid deletions or insertions, or both. Guidance in determining which amino acid residues may be substituted, inserted, or deleted without abolishing immunological activity may be found using computer programs well known in the art.

A mutation in a nucleotide sequence can be a single alteration made at a locus (a point mutation), such as transition or transversion mutations, or alternatively, multiple nucleotides may be inserted, deleted or changed at a single locus. In addition, one or more alterations may be made at any number of loci within a nucleotide sequence. The mutations may be performed by any suitable method known in the art.

Host

The term "host", as used herein, is intended to refer to an organism or a cell into which a vector such as a cloning vector or an expression vector has been introduced. The organism or cell can be prokaryotic or eukaryotic. It should be understood that this term is intended to refer not only to the particular subject organism or cell, but to the progeny of such an organism or cell as well. Because certain modifications may occur in succeeding generations due to either mutation or environmental influences, such progeny may not, in fact, be identical to the parent organism or cell, but are still included within the scope of the term "host" as used herein.

Human

The term "human", when applied to binding molecules as defined herein, refers to molecules that are either directly derived from a human or based upon a human sequence. When a binding molecule is derived from or based on a human sequence and subsequently modified, it is still to be considered human as used throughout the specification. In other words, the term human, when applied to binding molecules is intended to include binding molecules having variable and constant regions derived from human germline immunoglobulin sequences or based on variable or constant regions occurring in a human or human lymphocyte and modified in some form. Thus, the human binding molecules may include amino acid residues not encoded by human germline immunoglobulin sequences, comprise substitutions and/or deletions (e.g., mutations introduced by for instance random or site-specific mutagenesis in vitro or by somatic mutation in vivo). "Based on" as used herein refers to the situation that a nucleic acid sequence may be exactly copied from a template, or with minor mutations, such as by error-prone PCR methods, or synthetically made matching the template exactly or with minor modifications. Semi-synthetic molecules based on human sequences are also considered to be human as used herein.

Insertion

The term "insertion", also known as the term "addition", denotes a change in an amino acid or nucleotide sequence resulting in the addition of one or more amino acid or nucleotide residues, respectively, as compared to the parent sequence.

Intrinsic Activity

The term "intrinsic activity", when applied to binding molecules as defined herein, refers to binding molecules that are capable of binding to certain protein or carbohydrate antigens on the surface of pathogens such as bacteria and that can inhibit the ability of the pathogen to grow and divide normally. Such binding molecules can for example block the entry of specific nutrients required for growth or the transport of toxic waste elements from the bacteria. Through the latter action they may also increase the sensitivity of bacteria to the action of antibiotic drugs.

Isolated

The term "isolated", when applied to binding molecules as defined herein, refers to binding molecules that are substantially free of other proteins or polypeptides, particularly free of other binding molecules having different antigenic specificities, and are also substantially free of other cellular material and/or chemicals. For example, when the binding molecules are recombinantly produced, they are preferably substantially free of culture medium, and when the binding molecules are produced by chemical synthesis, they are preferably substantially free of chemical precursors or other chemicals, i.e., they are separated from chemical precursors or other chemicals which are involved in the synthesis of the protein. The term "isolated" when applied to nucleic acid molecules encoding binding molecules as defined herein, is intended to refer to nucleic acid molecules in which the nucleotide sequences encoding the binding molecules are free of other nucleotide sequences, particularly nucleotide sequences encoding binding molecules that bind binding partners other than enterococci. Furthermore, the term "isolated" refers to nucleic acid molecules that are substantially separated from other cellular components that naturally accompany the native nucleic acid molecule in its natural host, e.g., ribosomes, polymerases, or genomic sequences with which it is naturally associated. Moreover, "isolated" nucleic acid molecules, such as cDNA molecules, can be substantially free of other cellular material, or culture medium when produced by recombinant techniques, or substantially free of chemical precursors or other chemicals when chemically synthesized.

Monoclonal Antibody

The term "monoclonal antibody" as used herein refers to a preparation of antibody molecules of single molecular composition. A monoclonal antibody displays a single binding specificity and affinity for a particular epitope. Accordingly, the term "human monoclonal antibody" refers to an antibody displaying a single binding specificity which has variable and constant regions derived from or based on human germline immunoglobulin sequences or derived from completely synthetic sequences. The method of preparing the monoclonal antibody is not relevant.

Naturally Occurring

The term "naturally occurring" as used herein as applied to an object refers to the fact that an object can be found in nature. For example, a polypeptide or polynucleotide sequence that is present in an organism that can be isolated from a source in nature and which has not been intentionally modified by man in the laboratory is naturally occurring.

Nucleic Acid Molecule

The term "nucleic acid molecule" as used in the present invention refers to a polymeric form of nucleotides and includes both sense and anti-sense strands of RNA, cDNA, genomic DNA, and synthetic forms and mixed polymers of the above. A nucleotide refers to a ribonucleotide, deoxynucleotide or a modified form of either type of nucleotide. The term also includes single- and double-stranded forms of DNA. In addition, a polynucleotide may include either or both naturally occurring and modified nucleotides linked together by naturally occurring and/or non-naturally occurring nucleotide linkages. The nucleic acid molecules may be modified chemically or biochemically or may contain non-natural or derivatized nucleotide bases, as will be readily appreciated by those of skill in the art. Such modifications include, for example, labels, methylation, substitution of one or more of the naturally occurring nucleotides with an analog, internucleotide modifications such as uncharged linkages (e.g., methyl phosphonates, phosphotriesters, phosphoramidates, carbamates, etc.), charged linkages (e.g., phosphorothioates, phosphorodithioates, etc.), pendent moieties (e.g., polypeptides), intercalators (e.g., acridine, psoralen, etc.), chelators, alkylators, and modified linkages (e.g., alpha anomeric nucleic acids, etc.). The above term is also intended to include any topological conformation, including single-stranded, double-stranded, partially duplexed, triplex, hairpinned, circular and padlocked conformations. Also included are synthetic molecules that mimic polynucleotides in their ability to bind to a designated sequence via hydrogen bonding and other chemical interactions. Such molecules are known in the art and include, for example, those in which peptide linkages substitute for phosphate linkages in the backbone of the molecule. A reference to a nucleic acid sequence encompasses its complement unless otherwise specified. Thus, a reference to a nucleic acid molecule having a particular sequence should be understood to encompass its complementary strand, with its complementary sequence. The complementary strand is also useful, e.g., for anti-sense therapy, hybridization probes and PCR primers.

Operably Linked

The term "operably linked" refers to two or more nucleic acid sequence elements that are usually physically linked and are in a functional relationship with each other. For instance, a promoter is operably linked to a coding sequence, if the promoter is able to initiate or regulate the transcription or expression of a coding sequence, in which case the coding sequence should be understood as being "under the control of" the promoter.

Opsonic Activity

"Opsonic activity" refers to the ability of an opsonin (generally either a binding molecule, e.g. an antibody, or serum complement factors) to bind to the surface of a pathogen either by specific antigenic recognition (in the case of antibodies) or through the catalytic effect of surface bound molecules (e.g. the increased deposition of C3b as a result of surface bound antibodies). Phagocytosis of opsonized pathogens is enhanced due to the specific recognition of receptors on the phagocyte for the opsonin (the Fc receptor in case the antibodies themselves are the opsonins and the complement receptor in case complement is the opsonin). Certain bacteria, especially encapsulated bacteria that resist phagocytosis due to the presence of the capsule, become extremely attractive to phagocytes such as neutrophils and macrophages when coated with an opsonic antibody and their rate of clearance from the bloodstream and infected organs is strikingly enhanced. Opsonic activity may be measured in any conventional manner (e.g. the opsonic phagocytic killing assay).

Pharmaceutically Acceptable Excipient

By "pharmaceutically acceptable excipient" is meant any inert substance that is combined with an active molecule such as a drug, agent, or binding molecule for preparing an agreeable or convenient dosage form. The "pharmaceutically acceptable excipient" is an excipient that is non-toxic to recipients at the dosages and concentrations employed, and is compatible with other ingredients of the formulation comprising the drug, agent or binding molecule.

Specifically Binding

The term "specifically binding", as used herein, in reference to the interaction of a binding molecule, e.g. an antibody, and its binding partner, e.g. an antigen, means that the interaction is dependent upon the presence of a particular structure, e.g. an antigenic determinant or epitope, on the binding partner. In other words, the antibody preferentially binds or recognizes the binding partner even when the binding partner is present in a mixture of other molecules or organisms. The binding may be mediated by covalent or non-covalent interactions or a combination of both. In yet other words, the term "specifically binding" means immunospecifically binding to an antigen or a fragment thereof and not immunospecifically binding to other antigens. A binding molecule that immunospecifically binds to an antigen may bind to other peptides or polypeptides with lower affinity as determined by, e.g., radioimmunoassays (RIA), enzyme-linked immunosorbent assays (ELISA), BIACORE, or other assays known in the art. Binding molecules or fragments thereof that immunospecifically bind to an antigen may be cross-reactive with related antigens. Preferably, binding molecules or fragments thereof that immunospecifically bind to an antigen do not cross-react with other antigens.

Substitutions

A "substitution", as used herein, denotes the replacement of one or more amino acids or nucleotides by different amino acids or nucleotides, respectively.

Therapeutically Effective Amount

The term "therapeutically effective amount" refers to an amount of the binding molecule as defined herein that is effective for preventing, ameliorating and/or treating a condition resulting from infection with *Enterococcus*.

Treatment

The term "treatment" refers to therapeutic treatment as well as prophylactic or preventative measures to cure or halt or at least retard disease progress. Those in need of treatment include those already inflicted with a condition resulting from infection with *Enterococcus* as well as those in which infection with *Enterococcus* is to be prevented. Subjects partially or totally recovered from infection with *Enterococcus* might also be in need of treatment. Prevention encompasses inhibiting or reducing the spread of *Enterococcus* or inhibiting or reducing the onset, development or progression of one or more of the symptoms associated with infection with *Enterococcus*.

Vector

The term "vector" denotes a nucleic acid molecule into which a second nucleic acid molecule can be inserted for introduction into a host where it will be replicated, and in some cases expressed. In other words, a vector is capable of transporting a nucleic acid molecule to which it has been linked. Cloning as well as expression vectors are contemplated by the term "vector", as used herein. Vectors include, but are not limited to, plasmids, cosmids, bacterial artificial chromosomes (BAC) and yeast artificial chromosomes (YAC) and vectors derived from bacteriophages or plant or animal (including human) viruses. Vectors comprise an origin of replication recognized by the proposed host and in case of expression vectors, promoter and other regulatory regions recognized by the host. A vector containing a second nucleic acid molecule is introduced into a cell by transformation, transfection, or by making use of viral entry mechanisms. Certain vectors are capable of autonomous replication in a host into which they are introduced (e.g., vectors having a bacterial origin of replication can replicate in bacteria). Other vectors can be integrated into the genome of a host upon introduction into the host, and thereby are replicated along with the host genome.

SUMMARY OF THE INVENTION

The invention provides human binding molecules capable of specifically binding to enterococci and exhibiting killing and/or growth inhibiting activity against enterococci. The invention also pertains to nucleic acid molecules encoding at least the binding region of the human binding molecules. The invention further provides for the use of the human binding molecules of the invention in the prophylaxis and/or treatment of a subject having, or at risk of developing, an *Enterococcus* infection. Besides that, the invention pertains to the use of the human binding molecules of the invention in the diagnosis/detection of *Enterococcus*.

DETAILED DESCRIPTION OF THE INVENTION

In a first aspect the present invention encompasses binding molecules capable of specifically binding to an *Enterococcus* species. Preferably, the binding molecules are human binding molecules. Preferably, the binding molecules of the invention exhibit killing activity against an *Enterococcus* species. In a further aspect the binding molecules of the invention are capable of specifically binding to and/or have killing activity against at least two different *Enterococcus* species. Preferably the binding molecules of the invention are capable of specifically binding to and/or have killing activity against at least three, at least four, at least five, at least six, at least seven, at least eight, at least nine, at least ten, at least eleven, at least twelve, at least thirteen, at least fourteen, at least fifteen, at least sixteen, at least seventeen different *Enterococcus* species. *Enterococcus* species that the binding molecules of the invention are capable of specifically binding to and/or have killing activity against are selected from the group consisting of *E. asini, E. avium, E. casseliflavus, E. cecorum, E. columbae, E. dispar, E. durans, E. faecalis, E. faecium, E. flavescens, E. gallinarum, E. gilvus, E. haemoperxidus, E. hirae, E. malodoratus, E. moraviensis, E. mundtii, E. pallens, E. porcinus, E. pseudoavium, E. raffinosus, E. ratti, E. saccharolyticus, E. seriolicida, E. solitarius, E. sulfureus, E. villorum*, with *E. faecalis* and *E. faecium* being preferred species. In an embodiment the binding molecules of the invention are capable of specifically binding to and have killing activity against different strains within one *Enterococcus* species. In another embodiment, the binding molecules of the invention may even be capable of specifically binding to and/or have killing activity against at least one other Gram-positive bacterium and/or Gram-negative bacterium including, but not limited to, Group A streptococci; *Streptococcus pyogenes*, Group B streptococci; *Streptococcus agalactiae, Streptococcus milleri, Streptococcus pneumoniae*, Viridans streptococci; *Streptococcus mutans, Staphylococcus aureus, Staphylococcus epidermidis, Corynebacterium diphtheriae, Corynebacterium ulcerans, Corynebacterium pseudotuberculosis, Corynebacterium jeikeium, Corynebacterium xero-* sis, Corynebacterium pseudodiphtheriticum, Bacillus anthracis, Bacillus cereus, Listeria monocytogenes, Clostridium perfringens, Clostridium tetani, Clostridium botulinum, Clostridium difficile, Mycobacterium tuberculosis, Mycobacterium leprae, Actinomyces israelii, Nocardia asteroides, Norcardia brasiliensis, Escherichia coli, Proteus mirabilis, Proteus vulgaris, Klebsiella pneumoniae, Salmonella typhi, Salmonella paratyphi A, B & C, Salmonella enteritidis, Salmonella cholerae-suis, Salmonella virchow, Salmonella typhimurium, Shigella dysenteriae, Shigella boydii, Shigella flexneri, Shigella sonnei, Pseudomonas aeruginosa, Pseudomonas mallei, Vibrio cholerae, Vibrio parahaemolyticus, Vibrio vulnificus, Vibrio alginolyticus, Campylobacter pylori, Helicobacter pylori, Campylobacter jejuni, Bacteroides fragilis, Neisseria gonorrhoeae, Neisseria meningitidis, Branhamella catarrhalis, Haemophilus influenzae, Haemophilus ducreyi, Bordetella pertussis, Brucella abortus, Brucella abortus, Brucella melitensis, Legionella pneumophila, Treponema pallidum, Treponema carateum, Leptospira interrogans, Leptospira biflexa, Borrelia recurrentis, Borrelia burgdorferi, Mycoplasma pneumoniae, Coxiella burnetii, Clamydia trachomatis, Clamydia psittaci, Clamydia pneumoniae. The binding molecules of the invention may be capable of specifically binding to enterococci and optionally other Gram-positive and/or Gram-negative bacteria that are viable, living and/or infective or that are in inactivated/attenuated form. Methods for inactivating/attenuating bacteria are well known in the art and include, but are not limited to, antibiotic treatment, UV treatment, formaldehyde treatment, etc.

The binding molecules of the invention may also be capable of specifically binding to one or more fragments of enterococci (and other Gram-positive and/or Gram-negative bacteria) such as inter alia a preparation of one or more proteins and/or (poly)peptides derived from enterococci or one or more recombinantly produced enterococcal proteins and/or polypeptides. For methods of treatment and/or prevention of enterococcal infections the binding molecules are preferably capable of specifically binding to surface accessible proteins of enterococci. For diagnostical purposes the binding molecules may also be capable of specifically binding to proteins not present on the surface of enterococci. The nucleotide and/or amino acid sequence of proteins of various Enterococcus species and strains can be found in the GenBank-database, EMBL-database and/or other databases. It is well within the reach of the skilled person to find such sequences in the respective databases.

Alternatively, binding molecules of the invention may also be capable of specifically binding to other enterococcal molecules including, but not limited to, surface factors that inhibit phagocytic engulfment; factors that enhance their survival in phagocytes; invasins that lyse eukaryotic cell membranes; exotoxins that damage host tissues or otherwise provoke symptoms of disease; polysaccharides; other cell wall components such as teichoic acid, lipoteichoic acid, ribitol, peptidoglycan, pentaglycine oligopeptide, N-acetylglucosamine, N-acetylmuramic acid, N-acetylgalactosaminuronic acid, N-acetylfucosamine, N-acetylglucosaminuronic acid, N-acetylmannosaminuronic acid, O-acetyl, glucosamine, muramic acid, galactosaminuronic acid, fucosamine, glucosaminuronic acid, mannosaminuronic acid rhamnose, hexosamine, hexose, kojibiose, glycerol phosphate, ribitol phosphate and linkage units between any of these components.

In another embodiment the binding molecules of the invention are capable of specifically binding to a fragment of the above-mentioned proteins and/or other molecules, wherein the fragment at least comprises an antigenic determinant recognized by the binding molecules of the invention. An "antigenic determinant" as used herein is a moiety that is capable of binding to a binding molecule of the invention with sufficiently high affinity to form a detectable antigen-binding molecule complex.

The binding molecules of the invention can be intact immunoglobulin molecules such as polyclonal or monoclonal antibodies or the binding molecules can be antigen-binding fragments including, but not limited to, Fab, F(ab'), F(ab')$_2$, Fv, dAb, Fd, complementarity determining region (CDR) fragments, single-chain antibodies (scFv), bivalent single-chain antibodies, single-chain phage antibodies, diabodies, triabodies, tetrabodies, and (poly)peptides that contain at least a fragment of an immunoglobulin that is sufficient to confer specific antigen binding to enterococci or a fragment thereof. In a preferred embodiment the binding molecules of the invention are human monoclonal antibodies.

The binding molecules of the invention can be used in non-isolated or isolated form. Furthermore, the binding molecules of the invention can be used alone or in a mixture comprising at least one binding molecule (or variant or fragment thereof) of the invention. In other words, the binding molecules can be used in combination, e.g., as a pharmaceutical composition comprising two or more binding molecules of the invention, variants or fragments thereof. For example, binding molecules having different, but complementary activities can be combined in a single therapy to achieve a desired prophylactic, therapeutic or diagnostic effect, but alternatively, binding molecules having identical activities can also be combined in a single therapy to achieve a desired prophylactic, therapeutic or diagnostic effect. Optionally, the mixture further comprises at least one other therapeutic agent. Preferably, the therapeutic agent such as e.g. an antibiotic is useful in the prophylaxis and/or treatment of an enterococcal infection.

Typically, binding molecules according to the invention can bind to their binding partners, i.e. enterococci or fragments thereof, with an affinity constant ($K_d$-value) that is lower than $0.2*10^{-4}$ M, $1.0*10^{-5}$ M, $1.0*10^{-6}$ M, $1.0*10^{-7}$ M, preferably lower than $1.0*10^{-8}$ M, more preferably lower than $1.0*10^{-9}$ M, more preferably lower than $1.0*10^{-10}$ M, even more preferably lower than $1.0*10^{-11}$ M, and in particular lower than $1.0*10^{-12}$ M. The affinity constants can vary for antibody isotypes. For example, affinity binding for an IgM isotype refers to a binding affinity of at least about $1.0*10^{-7}$ M. Affinity constants can for instance be measured using surface plasmon resonance, for example using the BIACORE system (Pharmacia Biosensor AB, Uppsala, Sweden).

The binding molecules according to the invention may bind to enterococci or a fragment thereof in soluble form such as for instance in a sample or in suspension or may bind to enterococci or a fragment thereof bound or attached to a carrier or substrate, e.g., microiter plates, membranes and beads, etc. Carriers or substrates may be made of glass, plastic (e.g., polystyrene), polysaccharides, nylon, nitrocellulose, or Teflon, etc. The surface of such supports may be solid or porous and of any convenient shape. Furthermore, the binding molecules may bind to enterococci in purified/isolated or non-purified/non-isolated form.

The binding molecules of the invention exhibit killing activity. Killing activity as meant herein includes, but is not limited to, opsonic activity or any other activity increasing/augmenting/enhancing phagocytosis and/or phagocytic killing of bacteria, e.g. enterococci; intrinsic (killing) activity, e.g. reduce or inhibit bacterial growth or directly kill bacteria; increase the sensitivity of bacteria to antibiotic treatment; or any combination thereof. Opsonic activity can for instance be measured as described herein. Alternative assays measuring opsonic activity are described in for instance Manual of Molecular and Clinical Laboratory Immunology, 7th Edition. Assays to measure the other mentioned activities are also known.

In a preferred embodiment, the binding molecules according to the invention comprise at least a CDR3 region, preferably a heavy chain CDR3 region, comprising the amino acid sequence selected from the group consisting of SEQ ID NO:3, SEQ ID NO:9, SEQ ID NO:15, SEQ ID NO:21, SEQ ID NO:27, SEQ ID NO:33, SEQ ID NO:39, SEQ ID NO:45, SEQ ID NO:51, SEQ ID NO:57, SEQ ID NO:196, SEQ ID NO:202, SEQ ID NO:220, SEQ ID NO:226, SEQ ID NO:232, SEQ ID NO:238, SEQ ID NO:244, SEQ ID NO:250, SEQ ID NO:256, SEQ ID NO:262, SEQ ID NO:268, SEQ ID NO:274, SEQ ID NO:280, SEQ ID NO:286, SEQ ID NO:292, SEQ ID NO:298, SEQ ID NO:304, SEQ ID NO:310, SEQ ID NO:316, SEQ ID NO:322, SEQ ID NO:328, SEQ ID NO:334, SEQ ID NO:340, and SEQ ID NO:346. The CDR regions of the binding molecules of the invention are shown in Table 11. CDR regions are according to Kabat et al. (1991) as described in Sequences of Proteins of Immunological Interest. In an embodiment binding molecules may comprise two, three, four, five or even all six CDR regions of the binding molecules of the invention.

In yet another embodiment, the binding molecules according to the invention comprise a heavy chain comprising the variable heavy chain of the amino acid sequence selected from the group consisting of SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:211, SEQ ID NO:213, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, and SEQ ID NO:437. In a further embodiment, the binding molecules according to the invention comprise a light chain comprising the variable light chain of the amino acid sequence selected from the group consisting of SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:215, SEQ ID NO:217, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, and SEQ ID NO:481. Table 12 specifies the heavy and light chain variable regions of the binding molecule of the invention.

Another aspect of the invention includes functional variants of the binding molecules as defined herein. Molecules are considered to be functional variants of a binding molecule according to the invention, if the variants are capable of competing for specifically binding to enterococci (or other Gram-positive and/or Gram-negative bacteria) or a fragment thereof with the parental human binding molecules. In other words, when the functional variants are still capable of binding to enterococci or a fragment thereof. Preferably, the functional variants are capable of competing for specifically binding to at least two (or more) different *Enterococcus* species or fragments thereof that are specifically bound by the parental human binding molecules. Furthermore, molecules are considered to be functional variants of a binding molecule according to the invention, if they have killing activity against enterococci, preferably against the at least two (or more) *Enterococcus* species against which the parental binding molecule exhibits killing activity. In another embodiment the functional variants of a binding molecule according to the invention also have killing activity against other Gram-positive and/or Gram-negative bacteria. Functional variants include, but are not limited to, derivatives that are substantially similar in primary structural sequence, but which contain e.g. in vitro or in vivo modifications, chemical and/or biochemical, that are not found in the parental binding molecule. Such modifications include inter alia acetylation, acylation, covalent attachment of a nucleotide or nucleotide derivative, covalent attachment of a lipid or lipid derivative, cross-linking, disulfide bond formation, glycosylation, hydroxylation, methylation, oxidation, pegylation, proteolytic processing, phosphorylation, and the like.

Alternatively, functional variants can be binding molecules as defined in the present invention comprising an amino acid sequence containing substitutions, insertions, deletions or combinations thereof of one or more amino acids compared to the amino acid sequences of the parental binding molecules. Furthermore, functional variants can comprise truncations of the amino acid sequence at either or both the amino or carboxyl termini. Functional variants according to the invention may have the same or different, either higher or lower, binding affinities compared to the parental binding molecule but are still capable of binding to enterococci or a fragment thereof. For instance, functional variants according to the invention may have increased or decreased binding affinities for enterococci or a fragment thereof compared to the parental binding molecules. Preferably, the amino acid sequences of the variable regions, including, but not limited to, framework regions, hypervariable regions, in particular the CDR3 regions, are modified. Generally, the light chain and the heavy chain variable regions comprise three hypervariable regions, comprising three CDRs, and more conserved regions, the so-called framework regions (FRs). The hypervariable regions comprise amino acid residues from CDRs and amino acid residues from hypervariable loops. Functional variants intended to fall within the scope of the present invention have at least about 50% to about 99%, preferably at least about 60% to about 99%, more preferably at least about 70% to about 99%, even more preferably at least about 80% to about 99%, most preferably at least about 90% to about 99%, in particular at least about 95% to about 99%, and in particular at least about 97% to about 99% amino acid sequence homology with the parental human binding molecules as defined herein. Computer algorithms such as inter alia Gap or Bestfit known to a person skilled in the art can be used to optimally align amino acid sequences to be compared and to define similar or identical amino acid residues. Functional variants can be obtained by altering the parental binding molecules or parts thereof by general molecular biology methods known in the art including, but not limited to, error-prone PCR, oligonucleotide-directed mutagenesis, site-directed mutagenesis and heavy and/or light chain shuffling. In an embodiment the functional variants of the invention have killing activity against enterococci. The killing activity may either be identical, or be higher or lower compared to the parental binding molecules. Furthermore, the functional variants having killing activity may have a further activity suitable in enterococcal control. Other activities are mentioned above. Henceforth, when the term (human) binding molecule is used, this also encompasses functional variants of the (human) binding molecule.

The invention provides a panel of useful human monoclonal antibodies that have opsonic phagocytic killing activity against at least one strain of each of at least two different *Enterococcus* species and against at least one strain of *Staphylococcus aureus*. The antibodies of the invention comprise variable regions of any one of antibodies CR5140 (SEQ ID NO's 395+439), CR5157 (SEQ ID NO's 397+441), CR6016 (SEQ ID NO's 88+108), CR6043 (SEQ ID NO's 90+110), CR6050 (SEQ ID NO's 401+445), CR6078 (SEQ ID NO's 96+116), CR6087 (SEQ ID NO's211+215), CR6089 (SEQ ID NO's213+217), CR6241 (SEQ ID NO's 98+118), CR6252 (SEQ ID NO's 100+120), CR6388 (SEQ ID NO's 421+465), CR6389 (SEQ ID NO's 423+467), CR6396 (SEQ ID NO's 425+469), CR6402 (SEQ ID NO's 427+471), CR6409 (SEQ ID NO's 429+473), CR6415 (SEQ ID NO's 431+475), CR6421 (SEQ ID NO's 433+477) or CR6429 (SEQ ID NO's 435+479) as disclosed herein, and antibodies comprising variable regions with sequences that are at least 80%, preferably at least 90%, more preferably at least 95%, identical thereto. Preferably the sequences of the complete antibodies are at least 80%, more preferably at least 90%, still more preferably at least 95% identical to the sequences of these antibodies as disclosed herein. These antibodies were all shown have opsonic phagocytic killing activity against at least two different *Enterococcus* species (comprising *E. faecalis* and *E. faecium*). Surprisingly, these antibodies were also reactive against *S. aureus* (strain 502, and for some antibodies (CR6252, CR6415, CR6421) it was further shown that they were also reactive against strain Numan of *S. aureus*, as well as against *S. epidemidis* strainRP62A), and thus have a broad specificity and broad potential for therapeutic use. These antibodies did not bind to LTA of *S. aureus*, which is one of the main constituents of the cell wall of *S. aureus*. In certain embodiments, the antibodies of the invention therefore do not specifically bind to LTA of *S. aureus*. The invention also provides compositions comprising at least 2, at least 3, at least 4, at least 5, or more, of the human monoclonal antibodies of the invention. Of course, higher affinity mutants or mutants with other advantageous properties can be prepared according to routine methods, based on the sequences of the antibodies as disclosed herein. Such improved antibodies are included within the scope of the present invention, when the variable regions of heavy and light chain are at least 80%, preferably at least 90%, still more preferably at least 95% identical to the sequences of the variable regions of the antibodies disclosed herein.

In yet a further aspect, the invention includes immunoconjugates, i.e. molecules comprising at least one binding molecule as defined herein and further comprising at least one tag, such as inter alia a detectable moiety/agent. Also contemplated in the present invention are mixtures of immunoconjugates according to the invention or mixtures of at least one immunoconjugates according to the invention and another molecule, such as a therapeutic agent or another binding molecule or immunoconjugate. In a further embodiment, the immunoconjugates of the invention may comprise more than one tag. These tags can be the same or distinct from each other and can be joined/conjugated non-covalently to the binding molecules. The tag(s) can also be joined/conjugated directly to the human binding molecules through covalent bonding. Alternatively, the tag(s) can be joined/conjugated to the binding molecules by means of one or more linking compounds. Techniques for conjugating tags to binding molecules are well known to the skilled artisan.

The tags of the immunoconjugates of the present invention may be therapeutic agents, but they can also be detectable moieties/agents. Tags suitable in therapy and/or prevention may be toxins or functional parts thereof, antibiotics, enzymes, other binding molecules that enhance phagocytosis or immune stimulation. Immunoconjugates comprising a detectable agent can be used diagnostically to, for example, assess if a subject has been infected with an *Enterococcus* species or monitor the development or progression of an enterococcal infection as part of a clinical testing procedure to, e.g., determine the efficacy of a given treatment regimen. However, they may also be used for other detection and/or analytical and/or diagnostic purposes. Detectable moieties/agents include, but are not limited to, enzymes, prosthetic groups, fluorescent materials, luminescent materials, bioluminescent materials, radioactive materials, positron emitting metals, and non-radioactive paramagnetic metal ions. The tags used to label the binding molecules for detection and/or analytical and/or diagnostic purposes depend on the specific detection/analysis/diagnosis techniques and/or methods used such as inter alia immunohistochemical staining of (tissue) samples, flow cytometric detection, scanning laser cytometric detection, fluorescent immunoassays, enzyme-linked immunosorbent assays (ELISA's), radioimmunoassays (RIA's), bioassays (e.g., phagocytosis assays), Western blotting applications, etc. Suitable labels for the detection/analysis/diagnosis techniques and/or methods known in the art are well within the reach of the skilled artisan.

Furthermore, the human binding molecules or immunoconjugates of the invention can also be attached to solid supports, which are particularly useful for in vitro immunoassays or purification of enterococci or a fragment thereof. Such solid supports might be porous or nonporous, planar or nonplanar. The binding molecules of the present invention can be fused to marker sequences, such as a peptide to facilitate purification. Examples include, but are not limited to, the hexa-histidine tag, the hemagglutinin (HA) tag, the myc tag or the flag tag. Alternatively, an antibody can be conjugated to a second antibody to form an antibody heteroconjugate. In another aspect the binding molecules of the invention may be conjugated/attached to one or more antigens. Preferably, these antigens are antigens which are recognized by the immune system of a subject to which the binding molecule-antigen conjugate is administered. The antigens may be identical, but may also differ from each other. Conjugation methods for attaching the antigens and binding molecules are well known in the art and include, but are not limited to, the use of cross-linking agents. The binding molecules of the invention will bind to enterococci and the antigens attached to the binding molecules will initiate a powerful T-cell attack on the conjugate, which will eventually lead to the destruction of the enterococci.

Next to producing immunoconjugates chemically by conjugating, directly or indirectly, via for instance a linker, the immunoconjugates can be produced as fusion proteins comprising the binding molecules of the invention and a suitable tag. Fusion proteins can be produced by methods known in the art such as, e.g., recombinantly by constructing nucleic acid molecules comprising nucleotide sequences encoding the binding molecules in frame with nucleotide sequences encoding the suitable tag(s) and then expressing the nucleic acid molecules.

It is another aspect of the present invention to provide a nucleic acid molecule encoding at least a binding molecule, functional variant or immunoconjugate according to the invention. Such nucleic acid molecules can be used as intermediates for cloning purposes, e.g. in the process of affinity maturation as described above. In a preferred embodiment, the nucleic acid molecules are isolated or purified.

The skilled man will appreciate that functional variants of these nucleic acid molecules are also intended to be a part of the present invention. Functional variants are nucleic acid sequences that can be directly translated, using the standard genetic code, to provide an amino acid sequence identical to that translated from the parental nucleic acid molecules.

Preferably, the nucleic acid molecules encode binding molecules comprising a CDR3 region, preferably a heavy chain CDR3 region, comprising an amino acid sequence selected from the group consisting of SEQ ID NO:3, SEQ ID NO:9, SEQ ID NO:15, SEQ ID NO:21, SEQ ID NO:27, SEQ ID NO:33, SEQ ID NO:39, SEQ ID NO:45, SEQ ID NO:51, SEQ ID NO:57, SEQ ID NO:196, SEQ ID NO:202, SEQ ID NO:220, SEQ ID NO:226, SEQ ID NO:232, SEQ ID NO:238, SEQ ID NO:244, SEQ ID NO:250, SEQ ID NO:256, SEQ ID NO:262, SEQ ID NO:268, SEQ ID NO:274, SEQ ID NO:280, SEQ ID NO:286, SEQ ID NO:292, SEQ ID NO:298, SEQ ID NO:304, SEQ ID NO:310, SEQ ID NO:316, SEQ ID NO:322, SEQ ID NO:328, SEQ ID NO:334, SEQ ID NO:340, and SEQ ID NO:346. In a further embodiment the nucleic acid molecules encode binding molecules comprising two, three, four, five or even all six CDR regions of the binding molecules of the invention.

In another embodiment, the nucleic acid molecules encode binding molecules comprising a heavy chain comprising the variable heavy chain of the amino acid sequence selected from the group consisting of SEQ ID NO:82, SEQ ID NO:84, SEQ ID NO:86, SEQ ID NO:88, SEQ ID NO:90, SEQ ID NO:92, SEQ ID NO:94, SEQ ID NO:96, SEQ ID NO:98, SEQ ID NO:100, SEQ ID NO:211, SEQ ID NO:213, SEQ ID NO:395, SEQ ID NO:397, SEQ ID NO:399, SEQ ID NO:401, SEQ ID NO:403, SEQ ID NO:405, SEQ ID NO:407, SEQ ID NO:409, SEQ ID NO:411, SEQ ID NO:413, SEQ ID NO:415, SEQ ID NO:417, SEQ ID NO:419, SEQ ID NO:421, SEQ ID NO:423, SEQ ID NO:425, SEQ ID NO:427, SEQ ID NO:429, SEQ ID NO:431, SEQ ID NO:433, SEQ ID NO:435, and SEQ ID NO:437. In another embodiment the nucleic acid molecules encode binding molecules comprising a light chain comprising the variable light chain of the amino acid sequence selected from the group consisting of SEQ ID NO:102, SEQ ID NO:104, SEQ ID NO:106, SEQ ID NO:108, SEQ ID NO:110, SEQ ID NO:112, SEQ ID NO:114, SEQ ID NO:116, SEQ ID NO:118, SEQ ID NO:120, SEQ ID NO:215, SEQ ID NO:217, SEQ ID NO:439, SEQ ID NO:441, SEQ ID NO:443, SEQ ID NO:445, SEQ ID NO:447, SEQ ID NO:449, SEQ ID NO:451, SEQ ID NO:453, SEQ ID NO:455, SEQ ID NO:457, SEQ ID NO:459, SEQ ID NO:461, SEQ ID NO:463, SEQ ID NO:465, SEQ ID NO:467, SEQ ID NO:469, SEQ ID NO:471, SEQ ID NO:473, SEQ ID NO:475, SEQ ID NO:477, SEQ ID NO:479, and SEQ ID NO:481.

It is another aspect of the invention to provide vectors, i.e. nucleic acid constructs, comprising one or more nucleic acid molecules according to the present invention. Vectors can be derived from plasmids such as inter alia F, R1, RP1, Col, pBR322, TOL, Ti, etc; cosmids; phages such as lambda, lambdoid, M13, Mu, P1, P22, Qβ, T-even, T-odd, T2, T4, T7, etc; plant viruses. Vectors can be used for cloning and/or for expression of the binding molecules of the invention and might even be used for gene therapy purposes. Vectors comprising one or more nucleic acid molecules according to the invention operably linked to one or more expression-regulating nucleic acid molecules are also covered by the present invention. The choice of the vector is dependent on the recombinant procedures followed and the host used. Introduction of vectors in host cells can be effected by inter alia calcium phosphate transfection, virus infection, DEAE-dextran mediated transfection, lipofectamin transfection or electroporation. Vectors may be autonomously replicating or may replicate together with the chromosome into which they have been integrated. Preferably, the vectors contain one or more selection markers. The choice of the markers may depend on the host cells of choice, although this is not critical to the invention as is well known to persons skilled in the art. They include, but are not limited to, kanamycin, neomycin, puromycin, hygromycin, zeocin, thymidine kinase gene from Herpes simplex virus (HSV-TK), dihydrofolate reductase gene from mouse (dhfr). Vectors comprising one or more nucleic acid molecules encoding the human binding molecules as described above operably linked to one or more nucleic acid molecules encoding proteins or peptides that can be used to isolate the human binding molecules are also covered by the invention. These proteins or peptides include, but are not limited to, glutathione-S-transferase, maltose binding protein, metal-binding polyhistidine, green fluorescent protein, luciferase and beta-galactosidase.

Hosts containing one or more copies of the vectors mentioned above are an additional subject of the present invention. Preferably, the hosts are host cells. Host cells include, but are not limited to, cells of mammalian, plant, insect, fungal or bacterial origin. Bacterial cells include, but are not limited to, cells from Gram-positive bacteria or Gram-negative bacteria such as several species of the genera *Escherichia*, such as *E. coli*, and *Pseudomonas*. In the group of fungal cells preferably yeast cells are used. Expression in yeast can be achieved by using yeast strains such as inter alia *Pichia pastoris, Saccharomyces cerevisiae* and *Hansenula polymorpha*. Furthermore, insect cells such as cells from *Drosophila* and Sf9 can be used as host cells. Besides that, the host cells can be plant cells such as inter alia cells from crop plants such as forestry plants, or cells from plants providing food and raw materials such as cereal plants, or medicinal plants, or cells from ornamentals, or cells from flower bulb crops. Transformed (transgenic) plants or plant cells are produced by known methods, for example, *Agrobacterium*-mediated gene transfer, transformation of leaf discs, protoplast transformation by polyethylene glycol-induced DNA transfer, electroporation, sonication, microinjection or bolistic gene transfer. Additionally, a suitable expression system can be a baculovirus system. Expression systems using mammalian cells such as Chinese Hamster Ovary (CHO) cells, COS cells, BHK cells or Bowes melanoma cells are preferred in the present invention. Mammalian cells provide expressed proteins with posttranslational modifications that are most similar to natural molecules of mammalian origin. Since the present invention deals with molecules that may have to be administered to humans, a completely human expression system would be particularly preferred. Therefore, even more preferably, the host cells are human cells. Examples of human cells are inter alia HeLa, 911, AT1080, A549, 293 and HEK293T cells. In preferred embodiments, the human producer cells comprise at least a functional part of a nucleic acid sequence encoding an adenovirus E1 region in expressible format. In even more preferred embodiments, said host cells are derived from a human retina and immortalized with nucleic acids comprising adenoviral E1 sequences, such as 911 cells or the cell line deposited at the European Collection of Cell Cultures (ECACC), CAMR, Salisbury, Wiltshire SP4

OJG, Great Britain on 29 Feb. 1996 under number 96022940 and marketed under the trademark PER.C6® (PER.C6 is a registered trademark of Crucell Holland B.V.). For the purposes of this application "PER.C6" refers to cells deposited under number 96022940 or ancestors, passages up-stream or downstream as well as descendants from ancestors of deposited cells, as well as derivatives of any of the foregoing. Production of recombinant proteins in host cells can be performed according to methods well known in the art. The use of the cells marketed under the trademark PER.C6® as a production platform for proteins of interest has been described in WO 00/63403 the disclosure of which is incorporated herein by reference in its entirety.

A method of producing a binding molecule according to the invention is an additional part of the invention. The method comprises the steps of a) culturing a host according to the invention under conditions conducive to the expression of the binding molecule, and b) optionally, recovering the expressed binding molecule. The expressed binding molecules or immunoconjugates can be recovered from the cell free extract, but preferably they are recovered from the culture medium. The above method of producing can also be used to make functional variants of the binding molecules and/or immunoconjugates of the present invention. Methods to recover proteins, such as binding molecules, from cell free extracts or culture medium are well known to the man skilled in the art. Binding molecules, functional variants and/or immunoconjugates as obtainable by the above-described method are also a part of the present invention.

Alternatively, next to the expression in hosts, such as host cells, the binding molecules and immunoconjugates of the invention can be produced synthetically by conventional peptide synthesizers or in cell-free translation systems using RNA nucleic acid derived from DNA molecules according to the invention. Binding molecules and immunoconjugates as obtainable by the above described synthetic production methods or cell-free translation systems are also a part of the present invention.

In yet another embodiment, binding molecules of the present invention can also be produced in transgenic, non-human, mammals such as inter alia rabbits, goats or cows, and secreted into for instance the milk thereof.

In yet another alternative embodiment, binding molecules according to the present invention, preferably human binding molecules specifically binding to enterococci or a fragment thereof, may be generated by transgenic non-human mammals, such as for instance transgenic mice or rabbits, that express human immunoglobulin genes. Preferably, the transgenic non-human mammals have a genome comprising a human heavy chain transgene and a human light chain transgene encoding all or a portion of the human binding molecules as described above. The transgenic non-human mammals can be immunized with a purified or enriched preparation of enterococci or a fragment thereof. Protocols for immunizing non-human mammals are well established in the art. See Using Antibodies: A Laboratory Manual, Edited by: E. Harlow, D. Lane (1998), Cold Spring Harbor Laboratory, Cold Spring Harbor, N.Y. and Current Protocols in Immunology, Edited by: J. E. Coligan, A. M. Kruisbeek, D. H. Margulies, E. M. Shevach, W. Strober (2001), John Wiley & Sons Inc., New York, the disclosures of which are incorporated herein by reference. Immunization protocols often include multiple immunizations, either with or without adjuvants such as Freund's complete adjuvant and Freund's incomplete adjuvant, but may also include naked DNA immunizations. In another embodiment, the human binding molecules are produced by B-cells or plasma cells derived from the transgenic animals. In yet another embodiment, the human binding molecules are produced by hybridomas, which are prepared by fusion of B-cells obtained from the above-described transgenic non-human mammals to immortalized cells. B-cells, plasma cells and hybridomas as obtainable from the above-described transgenic non-human mammals and human binding molecules as obtainable from the above-described transgenic non-human mammals, B-cells, plasma cells and hybridomas are also a part of the present invention.

In a further aspect, the invention provides a method of identifying a binding molecule, such as a human binding molecule, e.g. a human monoclonal antibody or fragment thereof, specifically binding to at least two different bacterial organisms or nucleic acid molecules encoding such binding molecules and comprises the steps of: (a) contacting a collection of binding molecules on the surface of replicable genetic packages with a first bacterial organism under conditions conducive to binding, (b) selecting at least once for a replicable genetic package binding to the first bacterial organism, (c) optionally, separating the replicable genetic package binding to the first bacterial organism from replicable genetic packages that do not bind to the first bacterial organism, contacting the separated replicable genetic packages with a second bacterial organism under conditions conducive to binding and selecting at least once for a replicable genetic package binding to the second bacterial organism, and (d) separating and recovering the replicable genetic package binding to the first and/or second bacterial organism from replicable genetic packages that do not bind to the first and/or second bacterial organism. Of course, the above methods extended with selections on third and further bacterial organisms are also part of the present invention. Another part of the invention is a method of identifying a binding molecule, such as a human binding molecule, e.g. a human monoclonal antibody or fragment thereof, specifically binding to an enterococcal species or nucleic acid molecules encoding such a binding molecule. Such a method comprises the same steps as the method mentioned above. A replicable genetic package as used herein can be prokaryotic or eukaryotic and includes cells, spores, yeasts, bacteria, viruses, (bacterio)phage, ribosomes and polysomes. A preferred replicable genetic package is a phage. The binding molecules, such as for instance single chain Fvs, are displayed on the replicable genetic package, i.e. they are attached to a group or molecule located at an exterior surface of the replicable genetic package. The replicable genetic package is a screenable unit comprising a binding molecule to be screened linked to a nucleic acid molecule encoding the binding molecule. The nucleic acid molecule should be replicable either in vivo (e.g., as a vector) or in vitro (e.g., by PCR, transcription and translation). In vivo replication can be autonomous (as for a cell), with the assistance of host factors (as for a virus) or with the assistance of both host and helper virus (as for a phagemid). Replicable genetic packages displaying a collection of binding molecules is formed by introducing nucleic acid molecules encoding exogenous binding molecules to be displayed into the genomes of the replicable genetic packages to form fusion proteins with endogenous proteins that are normally expressed from the outer surface of the replicable genetic packages. Expression of the fusion proteins, transport to the outer surface and assembly results in display of exogenous binding molecules from the outer surface of the replicable genetic packages.

The selection step(s) in the method according to the present invention can be performed with bacterial organisms that are live and still infective or inactivated. Inactivation of bacterial organism may be performed by bacterial inactivation methods well known to the skilled artisan such as inter alia treatment with low pH, i.e. pH 4 for 6 hours to 21 days; treatment with organic solvent/detergent, i.e. addition of organic solvents and detergents (Triton X-100 or Tween-80) to the bacterium; UV/light irradiation; gamma-irradiation; and treatment with relevant antibiotics. Methods to test, if a bacterial organism is still alive, infective and/or viable or partly or completely inactivated are well known to the person skilled in the art. The bacterial organisms used in the above method may be non-isolated, e.g. present in serum and/or blood of an infected individual. The bacterial organisms used may also be isolated as discrete colonies after overnight culture at 37° C. on a suitable medium such as sheep blood agar.

In an embodiment the first and/or second bacterial organisms are in suspension when contacted with the replicable genetic packages. Alternatively, they may also be coupled to a carrier when contact takes place. In another embodiment the first and second bacterial organisms are from a different bacterial family, e.g. the first is from a Gram-negative bacterium and the second is from a Gram-positive bacterium. This way, binding molecules capable of specifically binding to Gram-positive and Gram-negative bacteria can be found. Preferably, the first and second bacterial organisms are both Gram-positive bacteria. The first and second bacterial organism can both be enterococci. In one embodiment the first and second bacterial organism are different strains from the same bacterial species, e.g. an *Enterococcus* species such as *E. faecalis* or *E. faecium*. This way, species-specific binding molecules can be found that are capable of specifically binding to different strains within one species. In another embodiment the first and second bacterial organism are each a member of a different *Enterococcus* species, e.g. the first and second *Enterococcus* species are selected from the group consisting of *E. faecalis* and *E. faecium*. This way, binding molecules capable of specifically binding to different species within one bacterial genus can be found.

Alternatively, the selection step may be performed in the presence of a fragment of the bacterial organisms such as e.g. cell membrane preparations, cell membrane preparations that have been enzymically treated to remove proteins (e.g. with protease K), cell membrane preparations that have been enzymically treated to remove carbohydrate moieties (e.g. with periodate), recombinant proteins or polysaccharides. In yet another embodiment, the selection step may be performed in the presence of one or more proteins or (poly)peptides derived from the bacterial organisms, fusion proteins comprising these proteins or (poly)peptides, and the like. Extracellularly exposed parts of these proteins can also be used as selection material. The live or inactivated bacterial organisms or fragments thereof may be immobilized to a suitable material before use. Alternatively, live or inactivated bacteria in suspension are used. In an embodiment the selection can be performed on different materials derived from bacterial organisms. For instance, the first selection round can be performed on live or inactivated bacterial organisms in suspension, while the second and third selection round can be performed on recombinant bacterial proteins and polysaccharides, respectively. Of course, other combinations are also contemplated herein. Different bacterial materials can also be used during one selection/panning step. In a further aspect the invention provides methods wherein the bacterial organisms used in the selection step(s) are derived from the same or different growth phases of the bacteria, e.g. the lag phase, log phase, stationary phase or death phase. This way, e.g. phase-specific anti-bacterial binding molecules may be found. For instance, the first bacterial organism may be a *E. faecalis* in stationary phase, while the second bacterial organism is a *E. faecalis* in log phase or the first bacterial organism may be a *E. faecalis* in lag phase, while the second bacterial organism is a *E. faecium* in lag phase. Further combinations are well within the reach of the skilled artisan.

In yet a further aspect, the invention provides a method of obtaining a binding molecule specifically binding to at least two different bacterial organisms or a nucleic acid molecule encoding such a binding molecule, wherein the method comprises the steps of a) performing the above described method of identifying binding molecules, and b) isolating from the recovered replicable genetic package the binding molecule and/or the nucleic acid molecule encoding the binding molecule. The collection of binding molecules on the surface of replicable genetic packages can be a collection of scFvs or Fabs. Once a new scFv or Fab has been established or identified with the above-mentioned method of identifying binding molecules or nucleic acid molecules encoding the binding molecules, the DNA encoding the scFv or Fab can be isolated from the bacteria or phages and combined with standard molecular biological techniques to make constructs encoding bivalent scFvs or complete human immunoglobulins of a desired specificity (e.g. IgG, IgA or IgM). These constructs can be transfected into suitable cell lines and complete human monoclonal antibodies can be produced (see Huls et al., 1999; Boel et al., 2000).

As mentioned before the preferred replicable genetic package is a phage. Phage display methods for identifying and obtaining (human) binding molecules, e.g. (human) monoclonal antibodies, are by now well-established methods known by the person skilled in the art. They are e.g. described in U.S. Pat. No. 5,696,108; Burton and Barbas, 1994; de Kruif et al., 1995b; and Phage Display: A Laboratory Manual. Edited by: C F Barbas, D R Burton, J K Scott and G J Silverman (2001), Cold Spring Harbor Laboratory Press, Cold Spring Harbor, N.Y. All these references are herewith incorporated herein in their entirety. For the construction of phage display libraries, collections of human monoclonal antibody heavy and light chain variable region genes are expressed on the surface of bacteriophage, preferably filamentous bacteriophage, particles, in for example single-chain Fv (scFv) or in Fab format (see de Kruif et al., 1995b). Large libraries of antibody fragment-expressing phages typically contain more than $1.0*10^9$ antibody specificities and may be assembled from the immunoglobulin V-regions expressed in the B-lymphocytes of immunized- or non-immunized individuals. In a specific embodiment of the invention the phage library of binding molecules, preferably scFv phage library, is prepared from RNA isolated from cells obtained from a subject that has been vaccinated against a bacterium, recently vaccinated against an unrelated pathogen, recently suffered from a chronic or acute bacterial infection, e.g. enterococcal infection, or from a healthy individual. RNA can be isolated from inter alia bone marrow or peripheral blood, preferably peripheral blood lymphocytes or on isolated B-cells or even on subpopulations of B-cells. The subject can be an animal vaccinated against a bacterium or an animal that has or has had a bacterial infection. Preferably, the animal is a human subject that has been vaccinated against a bacterium or has or has had a chronic bacterial infection or an acute bacterial infection. Preferably, the human subject has recently recovered from the bacterial infection.

Alternatively, phage display libraries may be constructed from immunoglobulin variable regions that have been partially assembled in vitro to introduce additional antibody diversity in the library (semi-synthetic libraries). For example, in vitro assembled variable regions contain stretches of synthetically produced, randomized or partially randomized DNA in those regions of the molecules that are important for antibody specificity, e.g. CDR regions. Phage antibodies specific for bacteria such as enterococci can be selected from the library by exposing the bacteria or material thereof to a phage library to allow binding of phages expressing antibody fragments specific for the bacteria or material thereof. Non-bound phages are removed by washing and bound phages eluted for infection of E. coli bacteria and subsequent propagation. Multiple rounds of selection and propagation are usually required to sufficiently enrich for phages binding specifically to the bacteria or material thereof. If desired, before exposing the phage library to the bacteria or material thereof the phage library can first be subtracted by exposing the phage library to non-target material such as bacteria of a different family, species and/or strain or bacteria in a different growth phase or material of these bacteria. These subtractor bacteria or material thereof can be bound to a solid phase or can be in suspension. Phages may also be selected for binding to complex antigens such as complex mixtures of bacterial proteins or (poly)peptides optionally supplemented with bacterial polysaccharides or other bacterial material. Host cells expressing one or more proteins or (poly)peptides of bacteria such as enterococci may also be used for selection purposes. A phage display method using these host cells can be extended and improved by subtracting non-relevant binders during screening by addition of an excess of host cells comprising no target molecules or non-target molecules that are similar, but not identical, to the target, and thereby strongly enhance the chance of finding relevant binding molecules. Of course, the subtraction may be performed before, during or after the screening with bacterial organisms or material thereof. The process is referred to as the Mabstract™ process (Mabstract™ is a registered trademark of Crucell Holland B.V., see also U.S. Pat. No. 6,265,150 which is incorporated herein by reference).

In yet another aspect the invention provides a method of obtaining a binding molecule potentially having killing activity against a bacterial organism, preferably at least two different bacterial organisms, wherein the method comprises the steps of (a) performing the method of obtaining a binding molecule specifically binding to at least two different bacterial organisms or a nucleic acid molecule encoding such a binding molecule as described above, and (b) verifying if the binding molecule isolated has killing activity against the bacterial organism, preferably the at least two different bacterial organisms. Assays for verifying if a binding molecule has killing activity such as opsonic activity are well known in the art (see for instance Manual of Molecular and Clinical Laboratory Immunology, 7th Edition). In a further embodiment the binding molecule is also tested for any other activity. Other useful activities are mentioned above.

In a further aspect the invention pertains to a binding molecule having killing activity against at least two, preferably at least three or more, different bacterial organisms, such as e.g. enterococci, and being obtainable by the methods as described above. A pharmaceutical composition comprising the binding molecule, the pharmaceutical composition further comprising at least one pharmaceutically acceptable excipient is also an aspect of the present invention. Pharmaceutically acceptable excipients are well known to the skilled person. The pharmaceutical composition according to the invention may further comprise at least one other therapeutic agent. Suitable agents are also well known to the skilled artisan.

In yet a further aspect, the invention provides compositions comprising at least one binding molecule preferably a human monoclonal antibody according to the invention, at least one functional variant thereof, at least one immunoconjugate according to the invention or a combination thereof. In addition to that, the compositions may comprise inter alia stabilizing molecules, such as albumin or polyethylene glycol, or salts. Preferably, the salts used are salts that retain the desired biological activity of the binding molecules and do not impart any undesired toxicological effects. If necessary, the human binding molecules of the invention may be coated in or on a material to protect them from the action of acids or other natural or non-natural conditions that may inactivate the binding molecules.

In yet a further aspect, the invention provides compositions comprising at least one nucleic acid molecule as defined in the present invention. The compositions may comprise aqueous solutions such as aqueous solutions containing salts (e.g., NaCl or salts as described above), detergents (e.g., SDS) and/or other suitable components.

Furthermore, the present invention pertains to pharmaceutical compositions comprising at least one binding molecule such as a human monoclonal antibody of the invention (or functional fragment or variant thereof), at least one immunoconjugate according to the invention, at least one composition according to the invention, or combinations thereof. The pharmaceutical composition of the invention further comprises at least one pharmaceutically acceptable excipient.

In an embodiment the pharmaceutical compositions may comprise two or more binding molecules that have killing activity against a bacterial organism, e.g. an *Enterococcus* species. In an embodiment, the binding molecules exhibit synergistic killing activity, when used in combination. In other words, the compositions comprise at least two binding molecules having killing activity, characterized in that the binding molecules act synergistically in killing a bacterial organism such as e.g. an *Enterococcus* species. As used herein, the term "synergistic" means that the combined effect of the binding molecules when used in combination is greater than their additive effects when used individually. The synergistically acting binding molecules may bind to different structures on the same or distinct fragments of the bacterial organism. In an embodiment the binding molecules acting synergistically in killing a bacterial organism may also be capable of killing other bacterial organisms synergistically. A way of calculating synergy is by means of the combination index. The concept of the combination index (CI) has been described by Chou and Talalay, 1984. The two or more binding molecules having synergistic activity have distinct modes of action. For instance a first binding molecule may have opsonizing activity, while the second binding molecule has another activity increasing/augmenting/enhancing phagocytosis or a first binding molecule may have intrinsic (killing) activity, e.g. reduce or inhibit bacterial growth or directly kill bacteria, while the second binding molecule increases the sensitivity of bacteria to antibiotic treatment. It is to be understood that other combinations are also contemplated herein.

A pharmaceutical composition according to the invention can further comprise at least one other therapeutic, prophylactic and/or diagnostic agent. Preferably, the pharmaceutical composition comprises at least one other prophylactic and/or therapeutic agent. Preferably, said further therapeutic and/or prophylactic agents are agents capable of preventing and/or treating a bacterial, e.g. enterococcal, infection and/or a condition resulting from such an infection. Therapeutic and/or prophylactic agents include, but are not limited to, anti-bacterial agents. Such agents can be binding molecules, small molecules, organic or inorganic compounds, enzymes, polynucleotide sequences, anti-microbial peptides, etc. Other agents that are currently used to treat patients infected with bacterial infections such as enterococcal infections are antibiotics such as vancomycin, teicoplanin, synergistic combinations including ampicillin or vancomycin and an aminoglycoside or sulbactam, penicillins including extended spectrum penicillins, carbapenems, macrolides, quinolones, tetracyclines, chloramphenicol, daptomycin, linezolid, quinupristin/dalfopristin. These can be used in combination with the binding molecules of the invention. Agents capable of preventing and/or treating an infection with bacteria and/or a condition resulting from such an infection that are in the experimental phase might also be used as other therapeutic and/or prophylactic agents useful in the present invention.

The binding molecules or pharmaceutical compositions of the invention can be tested in suitable animal model systems prior to use in humans. Such animal model systems include, but are not limited to, murine sepsis and peritonitis models, rat sepsis and endocarditis models, and rabbit endocarditis models.

Typically, pharmaceutical compositions must be sterile and stable under the conditions of manufacture and storage. The binding molecules, immunoconjugates, nucleic acid molecules or compositions of the present invention can be in powder form for reconstitution in the appropriate pharmaceutically acceptable excipient before or at the time of delivery. In the case of sterile powders for the preparation of sterile injectable solutions, the preferred methods of preparation are vacuum drying and freeze-drying (lyophilization) that yield a powder of the active ingredient plus any additional desired ingredient from a previously sterile-filtered solution thereof.

Alternatively, the binding molecules, immunoconjugates, nucleic acid molecules or compositions of the present invention can be in solution and the appropriate pharmaceutically acceptable excipient can be added and/or mixed before or at the time of delivery to provide a unit dosage injectable form. Preferably, the pharmaceutically acceptable excipient used in the present invention is suitable to high drug concentration, can maintain proper fluidity and, if necessary, can delay absorption.

The choice of the optimal route of administration of the pharmaceutical compositions will be influenced by several factors including the physico-chemical properties of the active molecules within the compositions, the urgency of the clinical situation and the relationship of the plasma concentrations of the active molecules to the desired therapeutic effect. For instance, if necessary, the binding molecules of the invention can be prepared with carriers that will protect them against rapid release, such as a controlled release formulation, including implants, transdermal patches, and microencapsulated delivery systems. Biodegradable, biocompatible polymers can inter alia be used, such as ethylene vinyl acetate, polyanhydrides, polyglycolic acid, collagen, polyorthoesters, and polylactic acid. Furthermore, it may be necessary to coat the binding molecules with, or co-administer the binding molecules with, a material or compound that prevents the inactivation of the human binding molecules. For example, the binding molecules may be administered to a subject in an appropriate carrier, for example, liposomes or a diluent.

The routes of administration can be divided into two main categories, oral and parenteral administration. The preferred administration route is intravenous.

Oral dosage forms can be formulated inter alia as tablets, troches, lozenges, aqueous or oily suspensions, dispersable powders or granules, emulsions, hard capsules, soft gelatin capsules, syrups or elixirs, pills, dragees, liquids, gels, or slurries. These formulations can contain pharmaceutically excipients including, but not limited to, inert diluents, granulating and disintegrating agents, binding agents, lubricating agents, preservatives, coloring, flavoring or sweetening agents, vegetable or mineral oils, wetting agents, and thickening agents.

The pharmaceutical compositions of the present invention can also be formulated for parenteral administration. Formulations for parenteral administration can be inter alia in the form of aqueous or non-aqueous isotonic sterile non-toxic injection or infusion solutions or suspensions. The solutions or suspensions may comprise agents that are non-toxic to recipients at the dosages and concentrations employed such as 1,3-butanediol, Ringer's solution, Hank's solution, isotonic sodium chloride solution, oils, fatty acids, local anesthetic agents, preservatives, buffers, viscosity or solubility increasing agents, water-soluble antioxidants, oil-soluble antioxidants, and metal chelating agents.

In a further aspect, the binding molecules such as human monoclonal antibodies (functional fragments and variants thereof), immunoconjugates, compositions, or pharmaceutical compositions of the invention can be used as a medicament. So, a method of treatment and/or prevention of a bacterial (Gram-positive and/or Gram-negative), e.g. an enterococcal, infection using the binding molecules, immunoconjugates, compositions, or pharmaceutical compositions of the invention is another part of the present invention. The above-mentioned molecules can inter alia be used in the diagnosis, prophylaxis, treatment, or combination thereof, of a bacterial infection. Important clinical infections caused by enterococci include, but are not limited to, urinary tract infections, intra-abdominal, pelvic and soft tissue infections, bacteraemia, bacterial endocarditis, diverticulitis, meningitis, peritonitis, osteomyelitis, septic arthritis, abcesses, wound infections and pneumonia. They are suitable for treatment of yet untreated patients suffering from a bacterial infection and patients who have been or are treated for a bacterial infection. They may be used for patients such as hospitalized infants, infants born prematurely, burn victims, elderly patients, immunocompromised patients such as those receiving chemotherapy, immununosuppressed patients such as those receiving transplanted organs, immunodeficient patients, patient undergoing an invasive procedure, and health care workers. Each administration may protect against further infection by the bacterial organism for up to three or four weeks and/or will retard the onset or progress of the symptoms associated with the infection. The binding molecules of the invention may also increase the effectiveness of existing antibiotic treatment by increasing the sensitivity of the bacterium to the antibiotic, may stimulate the immune system to attack the bacterium in ways other than through opsonization. This activation may result in long lasting protection to the infection bacterium. Furthermore, the binding molecules of the invention may directly inhibit the growth of the bacterium or inhibit virulence factors required for its survival during the infection.

The above-mentioned molecules or compositions may be employed in conjunction with other molecules useful in diagnosis, prophylaxis and/or treatment. They can be used in vitro, ex vivo or in vivo. For instance, the binding molecules such as human monoclonal antibodies (or functional variants thereof), immunoconjugates, compositions or pharmaceutical compositions of the invention can be co-administered with a vaccine against the bacterial organism (if available). Alternatively, the vaccine may also be administered before or after administration of the molecules of the invention. Instead of a vaccine, anti-bacterial agents can also be employed in conjunction with the binding molecules of the present invention. Suitable anti-bacterial agents are mentioned above.

The molecules are typically formulated in the compositions and pharmaceutical compositions of the invention in a therapeutically or diagnostically effective amount. Alternatively, they may be formulated and administered separately. For instance the other molecules such as the anti-bacterial agents may be applied systemically, while the binding molecules of the invention may be applied intrathecally or intraventricularly.

Dosage regimens can be adjusted to provide the optimum desired response (e.g., a therapeutic response). A suitable dosage range may for instance be 0.1-100 mg/kg body weight, preferably 0.5-15 mg/kg body weight. Furthermore, for example, a single bolus may be administered, several divided doses may be administered over time or the dose may be proportionally reduced or increased as indicated by the exigencies of the therapeutic situation. The molecules and compositions according to the present invention are preferably sterile. Methods to render these molecules and compositions sterile are well known in the art. The other molecules useful in diagnosis, prophylaxis and/or treatment can be administered in a similar dosage regimen as proposed for the binding molecules of the invention. If the other molecules are administered separately, they may be administered to a patient prior to (e.g., 2 minutes, 5 minutes, 10 minutes, 15 minutes, 30 minutes, 45 minutes, 60 minutes, 2 hours, 4 hours, 6 hours, 8 hours, 10 hours, 12 hours, 14 hours, 16 hours, 18 hours, 20 hours, 22 hours, 24 hours, 2 days, 3 days, 4 days, 5 days, 7 days, 2 weeks, 4 weeks or 6 weeks before), concomitantly with, or subsequent to (e.g., 2 minutes, 5 minutes, 10 minutes, 15 minutes, 30 minutes, 45 minutes, 60 minutes, 2 hours, 4 hours, 6 hours, 8 hours, 10 hours, 12 hours, 14 hours, 16 hours, 18 hours, 20 hours, 22 hours, 24 hours, 2 days, 3 days, 4 days, 5 days, 7 days, 2 weeks, 4 weeks or 6 weeks after) the administration of one or more of the human binding molecules or pharmaceutical compositions of the invention. The exact dosing regimen is usually sorted out during clinical trials in human patients.

Human binding molecules and pharmaceutical compositions comprising the human binding molecules are particularly useful, and often preferred, when to be administered to human beings as in vivo therapeutic agents, since recipient immune response to the administered antibody will often be substantially less than that occasioned by administration of a monoclonal murine, chimeric or humanized binding molecule.

In another aspect, the invention concerns the use of the binding molecules such as killing human monoclonal antibodies (functional fragments and variants thereof), immunoconjugates, nucleic acid molecules, compositions or pharmaceutical compositions according to the invention in the preparation of a medicament for the diagnosis, prophylaxis, treatment, or combination thereof, of a bacterial (Gram-positive and/or Gram-negative), e.g. enterococcal infection.

Next to that, kits comprising at least one binding molecule such as a killing human monoclonal antibody (functional fragments and variants thereof), at least one immunoconjugate, at least one nucleic acid molecule, at least one composition, at least one pharmaceutical composition, at least one vector, at least one host according to the invention or a combination thereof are also a part of the present invention. Optionally, the above-described components of the kits of the invention are packed in suitable containers and labeled for diagnosis, prophylaxis and/or treatment of the indicated conditions. The above-mentioned components may be stored in unit or multi-dose containers as an aqueous, preferably sterile, solution or as a lyophilized, preferably sterile, formulation for reconstitution. The containers may be formed from a variety of materials such as glass or plastic and may have a sterile access port (for example the container may be an intravenous solution bag or a vial having a stopper pierceable by a hypodermic injection needle). The kit may further comprise more containers comprising a pharmaceutically acceptable buffer. It may further include other materials desirable from a commercial and user standpoint, including other buffers, diluents, filters, needles, syringes, culture medium for one or more of the suitable hosts and, possibly, even at least one other therapeutic, prophylactic or diagnostic agent. Associated with the kits can be instructions customarily included in commercial packages of therapeutic, prophylactic or diagnostic products, that contain information about for example the indications, usage, dosage, manufacture, administration, contra-indications and/or warnings concerning the use of such therapeutic, prophylactic or diagnostic products.

The binding molecules of the invention may also be used to coat medical devices or polymeric biomaterials.

The invention further pertains to a method of detecting a bacterial organism (Gram-positive and/or Gram-negative) in a sample, wherein the method comprises the steps of (a) contacting a sample with a diagnostically effective amount of a binding molecule (functional fragments and variants thereof) or an immunoconjugate according to the invention, and (b) determining whether the binding molecule or immunoconjugate specifically binds to a molecule of the sample. Preferably, the method is used to detect an *Enterococcus* in a sample. The sample may be a biological sample including, but not limited to blood, serum, urine, tissue or other biological material from (potentially) infected subjects, or a non-biological sample such as water, drink, etc. The (potentially) infected subjects may be human subjects, but also animals that are suspected as carriers of such a bacterial organism might be tested for the presence of the organism using the human binding molecules or immunoconjugates of the invention. The sample may first be manipulated to make it more suitable for the method of detection. Manipulation means inter alia treating the sample suspected to contain and/or containing the bacterial organism in such a way that the organism will disintegrate into antigenic components such as proteins, (poly)peptides or other antigenic fragments. Preferably, the human binding molecules or immunoconjugates of the invention are contacted with the sample under conditions which allow the formation of an immunological complex between the human binding molecules and the bacterial organism or antigenic components thereof that may be present in the sample. The formation of an immunological complex, if any, indicating the presence of the bacterial organism in the sample, is then detected and measured by suitable means. Such methods include, inter alia, homogeneous and heterogeneous binding immunoassays, such as radio-immunoassays (RIA), ELISA, immunofluorescence, immunohistochemistry, FACS, BIACORE and Western blot analyses.

Preferred assay techniques, especially for large-scale clinical screening of patient sera and blood and blood-derived products are ELISA and Western blot techniques. ELISA tests are particularly preferred. For use as reagents in these assays, the binding molecules or immunoconjugates of the invention are conveniently bonded to the inside surface of microliter wells. The binding molecules or immunoconjugates of the invention may be directly bonded to the microliter well. However, maximum binding of the binding molecules or immunoconjugates of the invention to the wells might be accomplished by pre-treating the wells with polylysine prior to the addition of the binding molecules or immunoconjugates of the invention. Furthermore, the binding molecules or immunoconjugates of the invention may be covalently attached by known means to the wells. Generally, the binding molecules or immunoconjugates are used between 0.01 to 100 µg/ml for coating, although higher as well as lower amounts may also be used. Samples are then added to the wells coated with the binding molecules or immunoconjugates of the invention.

Furthermore, binding molecules of the invention can be used to identify specific binding structures of a bacterial organism e.g. an *Enterococcus*. The binding structures can be epitopes on proteins and/or polypeptides. They can be linear, but also structural and/or conformational. In one embodiment, the binding structures can be analyzed by means of PEPSCAN analysis (see inter alia WO 84/03564, WO 93/09872, Slootstra et al., 1996). Alternatively, a random peptide library comprising peptides from a protein of a bacterial organism can be screened for peptides capable of binding to the binding molecules of the invention. The binding structures/peptides/epitopes found can be used as vaccines and for the diagnosis of bacterial infections. In case fragments other than proteins and/or polypeptides are bound by the binding molecules binding structures can be identified by mass spectrometry, high performance liquid chromatography and nuclear magnetic resonance.

In a further aspect, the invention provides a method of screening a binding molecule (or a functional fragment or variant thereof) for specific binding to the same epitope of a bacterial organism (Gram-positive and/or Gram-negative), e.g. *Enterococcus*, as the epitope bound by a human binding molecule of the invention, wherein the method comprises the steps of (a) contacting a binding molecule to be screened, a binding molecule of the invention and a bacterial organism or fragment thereof, (b) measure if the binding molecule to be screened is capable of competing for specifically binding to the bacterial organism or fragment thereof with the binding molecule of the invention. In a further step it may be determined, if the screened binding molecules that are capable of competing for specifically binding to the bacterial organism or fragment thereof have killing activity, e.g. opsonic activity. A binding molecule that is capable of competing for specifically binding to the bacterial organism or a fragment thereof with the binding molecule of the invention is another part of the present invention. In the above-described screening method, "specifically binding to the same epitope" also contemplates specific binding to substantially or essentially the same epitope as the epitope bound by the a binding molecule of the invention. The capacity to block, or compete with, the binding of the binding molecules of the invention to the bacterial organism typically indicates that a binding molecule to be screened binds to an epitope or binding site on the bacterial organism that structurally overlaps with the binding site on the bacterial organism that is immunospecifically recognized by the binding molecules of the invention. Alternatively, this can indicate that a binding molecule to be screened binds to an epitope or binding site which is sufficiently proximal to the binding site immunospecifically recognized by the binding molecules of the invention to sterically or otherwise inhibit binding of the binding molecules of the invention to the bacterial organism.

In general, competitive inhibition is measured by means of an assay, wherein an antigen composition, i.e. a composition comprising a bacterial organism or fragments thereof, is admixed with reference binding molecules, i.e. the binding molecules of the invention, and binding molecules to be screened. Usually, the binding molecules to be screened are present in excess. Protocols based upon ELISAs and Western blotting are suitable for use in such simple competition studies. By using species or isotype secondary antibodies one will be able to detect only the bound reference binding molecules, the binding of which will be reduced by the presence of a binding molecule to be screened that recognizes substantially the same epitope. In conducting a binding molecule competition study between a reference binding molecule and any binding molecule to be screened (irrespective of species or isotype), one may first label the reference binding molecule with a detectable label, such as, e.g., biotin, an enzymatic, a radioactive or other label to enable subsequent identification. Binding molecules identified by these competition assays ("competitive binding molecules" or "cross-reactive binding molecules") include, but are not limited to, antibodies, antibody fragments and other binding agents that bind to an epitope or binding site bound by the reference binding molecule, i.e. a binding molecule of the invention, as well as antibodies, antibody fragments and other binding agents that bind to an epitope or binding site sufficiently proximal to an epitope bound by the reference binding molecule for competitive binding between the binding molecules to be screened and the reference binding molecule to occur. Preferably, competitive binding molecules of the invention will, when present in excess, inhibit specific binding of a reference binding molecule to a selected target species by at least 10%, preferably by at least 25%, more preferably by at least 50%, and most preferably by at least 75%-90% or even greater. The identification of one or more competitive binding molecules that bind to about, substantially, essentially or at the same epitope as the binding molecules of the invention is a straightforward technical matter. As the identification of competitive binding molecules is determined in comparison to a reference binding molecule, i.e. a binding molecule of the invention, it will be understood that actually determining the epitope to which the reference binding molecule and the competitive binding molecule bind is not in any way required in order to identify a competitive binding molecule that binds to the same or substantially the same epitope as the reference binding molecule.

EXAMPLES

To illustrate the invention, the following examples are provided. The examples are not intended to limit the scope of the invention in any way.

Example 1

Construction of scFv Phage Display Libraries Using RNA Extracted from Donors Screened for Opsonic Activity Samples of blood were taken from donors reporting a recent gram-positive bacterial infection as well as healthy adults between 25-50 years of age. Peripheral blood leukocytes were isolated by centrifugation and the blood serum was saved and frozen at −80° C. Donor serum was screened for killing activity using an opsonophagocytic killing assay (Huebner et al. 1999) and compared to normal rabbit serum. Sera from donors having phagocytic activity greater than the normal serum were chosen to use for the generation of phage display libraries. Total RNA was prepared from the peripheral blood leukocytes of these donors using organic phase separation and subsequent ethanol precipitation. The obtained RNA was dissolved in RNAse free water and the concentration was determined by OD 260 nm measurement. Thereafter, the RNA was diluted to a concentration of 100 ng/μl. Next, 1 μg of RNA was converted into cDNA as follows: To 10 μl total RNA, 13 μl DEPC-treated ultrapure water and 1 μl random hexamers (500 ng/μl) were added and the obtained mixture was heated at 65° C. for 5 minutes and quickly cooled on wet-ice. Then, 8 μl 5× First-Strand buffer, 2 μl dNTP (10 mM each), 2 μl DTT (0.1 M), 2 μl RNAse-inhibitor (40 U/μl) and 2 μl Superscript™ MMLV reverse transcriptase (200 U/μl) were added to the mixture, incubated at room temperature for 5 minutes and incubated for 1 hour at 50° C. The reaction was terminated by heat inactivation, i.e. by incubating the mixture for 15 minutes at 75° C. The obtained cDNA products were diluted to a final volume of 200 μl with DEPC-treated ultrapure water. The OD 260 nm of a 50 times diluted solution (in 10 mM Tris buffer) of the dilution of the obtained cDNA products was used to determine the cDNA concentration. For each donor 5 to 10 μl of the diluted cDNA products were used as template for PCR amplification of the immunoglobulin gamma heavy chain family and kappa or lambda light chain sequences using specific oligonucleotide primers (see Tables 1-7). In addition, for one donor PCR amplification of the immunoglobulin mu heavy chain family and kappa or lambda light chain sequences was carried out. PCR reaction mixtures contained, besides the diluted cDNA products, 25 μmol sense primer and 25 μmol anti-sense primer in a final volume of 50 μl of 20 mM Tris-HCl (pH 8.4), 50 mM KCl, 1.5 mM $MgC_2$, 250 μM dNTPs and 1.25 units Taq polymerase. In a heated-lid thermal cycler having a temperature of 96° C., the mixtures obtained were quickly melted for 2 minutes, followed by 30 cycles of: 30 seconds at 96° C., 30 seconds at 55° C. or 60° C. and 60 seconds at 72° C. Finally, the samples were incubated 10 minutes at 72° C. and refrigerated at 4° C. until further use.

In a first round amplification, each of eighteen light chain variable region sense primers (twelve for the lambda light chain (see Table 1; the HuVL1A-Back, HuVL1B-Back and HuVL1C-Back sense primers were mixed to equimolarity before use, as well as the HuVL9-Back and HuVL10-Back sense primers) and six for the kappa light chain (see Table 2)) were combined with an anti-sense primer recognizing the C-kappa constant region called HuCK-FOR 5'-ACACTCTC-CCCTGTTGAAGCTCTT-3' (see SEQ ID NO:121) or C-lambda constant region HuCL2-FOR 5'-TGAACATTCT-GTAGGGGCCACTG-3' (see SEQ ID NO:122) and HuCL7-FOR 5'-AGAGCATTCTGCAGGGGCCACTG-3' (see SEQ ID NO:123) (the HuCL2-FOR and HuCL7-FOR anti-sense primers were mixed to equimolarity before use), yielding 15 products of about 650 base pairs. These products were purified on agarose gel and isolated from the gel using Qiagen gel-extraction columns. 1/10 of each of the isolated products was used in an identical PCR reaction as described above using eighteen sense primers, whereby each lambda light chain sense primer was combined with one of the three Jlambda-region specific anti-sense primers and each kappa light chain sense primer was combined with one of the five Jkappa-region specific anti-sense primers (see Table 3; the HuVL1A-Back-SAL, HuVL1B-Back-SAL and HuVL1C-Back-SAL sense primers were mixed to equimolarity before use, as well as the HuVL9-Back-SAL and HuVL10-Back-SAL sense primers). The sense primers used in the second amplification were the same primers as used in the first amplification, but extended with restriction sites (see Table 3) to enable directed cloning in the phage display vector PDV-$CO_6$ (see SEQ ID NO:124). This resulted in 57 products of approximately 400 base pairs that were pooled as shown in Table 4 to maintain the natural distribution of the different J segments and light chain families within the library and not to over or under represent certain families. The pooled products were purified using Qiagen PCR purification columns. In the next step, 3 μg of pooled products and 100 μg PDV-C06 vector were digested with SalI and NotI and purified from gel. Thereafter, a ligation was performed overnight at 16° C. as follows. To 500 ng PDV-C06 vector either 35, 70 or 140 ng pooled products were added in a total volume of 50 μl ligation mix containing 50 mM Tris-HCl (pH 7.5), 10 mM $MgCl_2$, 10 mM DTT, 1 mM ATP, 25 μg/ml BSA and 2.5 μl T4 DNA Ligase (400 U/μl). The ligation mixes were purified by phenol/chloroform extraction, followed by a chloroform extraction and ethanol precipitation, methods well known to the skilled artisan. The DNA obtained was dissolved in 50 μl 10 mM Tris-HCl pH8.5 and per ligation mix 1 or 2 μl was electroporated into 40 μl of TG1 competent E. coli bacteria according to the manufacturer's protocol (Stratagene). Transformants were grown overnight at 37° C. on 2TY agar supplemented with 50 μg/ml ampicillin and 4.5% glucose. Colonies were counted to determine the optimal vector to insert ratio. From the ligation mix with the optimal ratio, multiple 1 or 2 μl aliquots were electroporated as above and transformants were grown overnight at 37° C., typically yielding ~$10^7$ colonies. A (sub)library of variable light chain regions was obtained by scraping the transformants from the agar plates. This (sub)library was directly used for plasmid DNA preparation using a Qiagen™ QIAFilter MAXI prep kit.

Heavy chain immunoglobulin sequences were amplified from the same cDNA preparations in a similar two round PCR procedure and identical reaction parameters as described above for the light chain regions with the proviso that the primers depicted in Tables 5 and 6 were used. The first amplification was performed using a set of eight sense directed primers (see Table 5; the HuVH1B/7A-Back and HuVH1C-Back sense primers were mixed to equimolarity before use) each combined with an IgG specific constant region anti-sense primer called HuCIgG 5'-GTC CAC CTT GGT GTT GCT GGG CTT-3' (SEQ ID NO:125) yielding seven products of about 650 base pairs. For one donor an IgM specific constant region anti-sense primer called HuCIgM 5'-TGG AAG AGG CAC GTT CTT TTC TTT-3' (SEQ ID NO:126) was used instead of primer HuCIgG. The products were purified on agarose gel and isolated from the gel using Qiagen gel-extraction columns. 1/10 of each of the isolated products was used in an identical PCR reaction as described above using eight sense primers, whereby each heavy chain sense primer was combined with one of the four JH-region specific anti-sense primers (see Table 6; the HuVH1B/7A-Back-Sfi and HuVH1C-Back-Sfi sense primers were mixed to equimolarity before use). The sense primers used in the second round were the same primers as used in the first amplification, but extended with restriction sites (see Table 6) to enable directed cloning in the light chain (sub)library vector. This resulted in 28 products of approximately 400 base pairs that were pooled as shown in Table 7 to maintain the natural distribution of the different J segments and heavy chain families within the library and not to over or under represent certain families. The pooled products were purified using Qiagen PCR purification columns. Next, 3 μg of purified products was digested with SfiI and XhoI and ligated in the light chain (sub)library vector, which was cut with the same restriction enzymes, using the same ligation procedure and volumes as described above for the light chain (sub)library. Ligation mix purification and subsequent transformation of the resulting definitive library was also performed as described above for the light chain (sub)library. All bacteria, typically ~$10^7$, were harvested in 2TY culture medium containing 50 μg/ml ampicillin and 4.5% glucose, mixed with glycerol to 15% (v/v) and frozen in 1.5 ml aliquots at −80° C. Rescue and selection of each library were performed as described below. The various libraries were named GPB-05-M01, GPB-05-G01, GPB-05-G02, GPB-05-G03, GPB-05-G04 and GPB-05-G05. Two other libraries, RAB-03-G01 and RAB-04-G01, were constructed using a method similar to the procedure above, as described previously in international patent application WO 2005/118644.

Example 2

Construction of scFv Phage Display Libraries Using RNA Extracted from Memory B Cells Peripheral blood was collected from normal healthy donors, convalescent donors or vaccinated donors by venapunction using EDTA anti-coagulation sample tubes. A blood sample (45 ml) was diluted twice with PBS and 30 ml aliquots were underlayed with 10 ml Ficoll-Hypaque (Pharmacia) and centrifuged at 900×g for 20 minutes at room temperature without breaks. The supernatant was removed carefully to just above the white layer containing the lymphocytic and thrombocytic fraction. Next, this layer was carefully removed (~10 ml), transferred to a fresh 50 ml tube and washed three times with 40 ml PBS and spun at 400×g for 10 minutes at room temperature to remove thrombocytes. The obtained pellet containing lymphocytes was resuspended in RPMI medium containing 2% FBS and the cell number was determined by cell counting. Approximately $1\times10^8$ lymphocytes were stained for fluorescent cell sorting using CD24, CD27 and surface IgM as markers for the isolation of switched and IgM memory B cells. A Becton Dickinson Digital Vantage apparatus set in Yield Mode was used for physical memory B cell sorting and isolation. Lymphocytes were gated as the small compact population from the FSC/SSC window. Memory B cells (CD24+/CD27+) were subsequently separated from naive B cells (CD24+/CD27−) and memory T cells (CD24−/CD27+). In a next step, IgM memory B cells (IgM+) were separated from switch memory B cells (IgM−) using IgM expression. In this step IgM memory B cells and switch memory B cells were sorted in separate sample tubes. $1\times10^5$ to $1\times10^6$ cells of each population were collected in DMEM/50% FBS and after completion of the sort they were each centrifuged at 400×g for 10 minutes. The sorted IgM memory B cells were then used as starting material for library construction according to the method described in Example 1, using primer HuCIgM in the first round amplification of heavy chain immunoglobulin sequences. The various libraries were named MEM-05-M01, MEM-05-M02, MEM-05-M03, MEM-05-M04, MEM-05-M05, MEM-05-M06, MEM-05-M07, MEM-05-M08, MEM-05-M09 and MEM-05-M10.

Example 3

Selection of Phages Carrying Single Chain Fv Fragments Specifically Binding to Enterococci Antibody fragments were selected using antibody phage display libraries, general phage display technology and MAbstract® technology, essentially as described in U.S. Pat. No. 6,265,150 and in WO 98/15833 (both of which are incorporated by reference herein). The antibody phage libraries used were screened donor libraries prepared as described in Example 1 and IgM memory libraries prepared as described in Example 2. The methods and helper phages as described in WO 02/103012 (incorporated by reference herein) were used in the present invention. For identifying phage antibodies recognizing enterococci, phage selection experiments were performed using live bacteria in suspension or bacteria immobilized in immunotubes. The strains used are described in Table 8. All phage antibodies were isolated from selections wherein in at least one step E. faecalis 12030 in suspension was used. The phage antibodies called SC05-159 and SC05-166 were originally isolated from selections using immobilized E. faecalis 12030, but were later also isolated using E. faecalis 12030 in suspension.

Selections using bacteria in suspension were performed as follows. Bacteria were grown overnight at 37° C. on blood agar plates and scraped into PBS containing 2% BSA or 2% ELK at a concentration of $5\times10^9$ bacteria/ml and incubated for 30 minutes at room temperature. An aliquot of a phage library (approximately $10^{13}$ cfu, amplified using CT helper phage (see WO 02/103012)) was blocked in blocking buffer (2% ELK or 2% BSA in PBS) for 0.5-2 hours at room temperature. The blocked phage library was added to the blocked bacterial suspension making a total volume of 1 ml and incubated for 2 hours at room temperature in an end-over-end rotor (5 rpm). The suspension was centrifuged at 6800×g for 3 minutes at room temperature and the supernatant was discarded. Bacteria were washed three to eight times with blocking buffer containing 0.05% (v/v) Tween-20, then three to eight times with blocking buffer to remove unbound phages. Bound phages were eluted from the antigen by incubation with 1 ml of 0.1 M triethylamine for 7 minutes at room temperature in an end-over-end rotor (5 rpm). The suspension was centrifuged at 1700×g for 3 minutes at room temperature and the supernatant was then mixed with 0.5 ml of 1 M Tris-HCl pH 7.5 to neutralize the pH. This mixture was used to infect 5 ml of an XL1-Blue E. coli culture that had been grown at 37° C. to an OD 600 nm of approximately 0.3. The phages were allowed to infect the XL1-Blue bacteria for 30 minutes at 37° C. Then, the mixture was centrifuged for 10 minutes at 3200×g at room temperature and the bacterial pellet was resuspended in 0.5 ml 2-trypton yeast extract (2TY) medium. The obtained bacterial suspension was divided over two 2TY agar plates supplemented with tetracyclin, ampicillin and glucose. After overnight incubation of the plates at 37° C., the colonies were scraped from the plates and used to prepare an enriched phage library, essentially as described by De Kruif et al. (1995a) and WO 02/103012. Briefly, scraped bacteria were used to inoculate 2TY medium containing ampicillin, tetracycline and glucose and grown at a temperature of 37° C. to an OD 600 nm of ~0.3. CT helper phages were added and allowed to infect the bacteria after which the medium was changed to 2TY containing ampicillin, tetracycline and kanamycin. Incubation was continued overnight at 30° C. The next day, the bacteria were removed from the 2TY medium by centrifugation after which the phages in the medium were precipitated using polyethylene glycol (PEG) 6000/NaCl. Finally, the phages were dissolved in 2 ml of PBS with 1% bovine serum albumin (BSA), filter-sterilized and used for the next round of selection.

Selections using bacteria immobilized in immunotubes were performed as follows. Bacteria were grown overnight at 37° C. on blood agar plates and scraped into carbonate buffer at a concentration of $5\times10^9$ bacteria/ml. Two ml was added to a MaxiSorp Nunc-Immuno Tube (Nunc) and incubated overnight at 4° C. in an end-over-end rotor (5 rpm). The tube was emptied and washed three times with PBS. Both the tube and an aliquot of a phage library (approximately $10^{13}$ cfu, amplified using CT helper phage (see WO 02/103012)) were blocked in blocking buffer (2% ELK, 2% BSA or 1% Protifar in PBS) for 0.5-2 hours at room temperature. The tube was emptied, the blocked phage library was added and the tube was incubated for 2 hours at room temperature in an end-over-end rotor (5 rpm). The tube was washed five to fifteen times with PBS containing 0.1% (v/v) Tween-20, then five to fifteen times with PBS to remove unbound phages. Bound phages were eluted from the antigen by incubation with 1.5 ml of 0.1 M triethylamine or 50 mM Glycine-HCl, pH 2.2 for 10 minutes at room temperature in an end-over-end rotor (5 rpm). The eluted phages were mixed with 0.5 ml of 1 M Tris-HCl pH 7.5 to neutralize the pH. Subsequent infection of XL1-Blue *E. coli* bacteria, growth of infected bacteria and preparation of an enriched phage library was performed as described above for selections using bacteria in suspension.

Typically, two rounds of selections were performed before isolation of individual phage antibodies. Selection could be carried out twice on the same strain of bacteria or different strains could be used sequentially. After the second round of selection, individual *E. coli* colonies were used to prepare monoclonal phage antibodies. Essentially, individual colonies were grown to log-phase and infected with CT or VCSM13 helper phages after which phage antibody production was allowed to proceed overnight. The produced phage antibodies were PEG/NaCl-precipitated and filter-sterilized and tested in ELISA for binding to *Enterococcus* prepared as described supra.

Example 4

Validation of the Enterococcal Specific Single-Chain Phage Antibodies

Selected single-chain phage antibodies that were obtained in the screens described above were validated in ELISA for specific enterococcal binding activity, i.e. binding to one or more enterococcal strains prepared as described supra. 2.5×$10^8$ bacteria were coated overnight at 4° C. to Maxisorp™ ELISA plates in 50 µl 50 mM carbonate buffer, pH 9.6. As negative controls, the complex antigens 2% ELK and 1% BSA both in PBS (pH 7.4) were coated. Wells were washed in PBS containing 0.1% (v/v) Tween-20 and blocked with 300 µl PBS containing 2% ELK for at least 1 hour at room temperature. The selected single-chain phage antibodies were incubated for 15 minutes in an equal volume of PBS containing 2% ELK to obtain blocked phage antibodies. The plates were emptied and the blocked single-chain phage antibodies were added to the wells. Incubation was allowed to proceed for one hour at room temperature, the plates were washed in PBS containing 0.1% (v/v) Tween-20 and bound phage antibodies were detected using an anti-M13 antibody conjugated to peroxidase. Absorbance at 492 nm was measured using a spectrophotometer. As a control, the procedure was performed simultaneously without single-chain phage antibody and with a negative control single-chain phage antibody directed against West Nile virus envelope protein (SC04-374). As shown in Table 9, the selected phage antibodies called SC05-140, SC05-157, SC05-159, SC05-166, SC05-179, SC05-187, SC06-016, SC06-043, SC06-049, SC06-050, SC06-071, SC06-077, SC06-078, SC06-079, SC06-086, SC06-087, SC06-089, SC06-092, SC06-191, SC06-195, SC06-198, SC06-241, SC06-242, SC06-246, SC06-252, SC06-388, SC06-389, SC06-396, SC06-402, SC06-409, SC06-415, SC06-421, SC06-429 and SC06-432 specifically bound to *Enterococcus faecalis* strain 12030. With the exception of SC05-140 and SC06-421 none of the selected phage antibodies did display any detectable binding to the negative control antigens ELK and BSA.

Example 5

Characterization of the Enterococcal Specific scFvs

From the selected specific single-chain phage antibody (scFv) clones plasmid DNA was obtained and nucleotide sequences were determined according to standard techniques. The nucleotide sequences of the scFvs (including restriction sites for cloning) called SC05-140, SC05-157, SC05-159, SC05-166, SC05-179, SC05-187, SC06-016, SC06-043, SC06-049, SC05-050, SC06-071, SC06-077, SC06-078, SC06-079, SC06-086, SC06-087, SC06-089, SC06-092, SC06-191, SC06-195, SC06-198, SC06-241, SC06-242, SC06-246, SC06-252, SC06-388, SC06-389, SC06-396, SC06-402, SC06-409, SC06-415, SC06-421, SC06-429, and SC06-432 are shown in SEQ ID NO:350, SEQ ID NO:352, SEQ ID NO:61, SEQ ID NO:63, SEQ ID NO:354, SEQ ID NO:65, SEQ ID NO:67, SEQ ID NO:69, SEQ ID NO:71, SEQ ID NO:356, SEQ ID NO:73, SEQ ID NO:358, SEQ ID NO:75, SEQ ID NO:360, SEQ ID NO:362, SEQ ID NO:206, SEQ ID NO:208, SEQ ID NO:364, SEQ ID NO:366, SEQ ID NO:368, SEQ ID NO:370, SEQ ID NO:77, SEQ ID NO:372, SEQ ID NO:374, SEQ ID NO:79, SEQ ID NO:376, SEQ ID NO:378, SEQ ID NO:380, SEQ ID NO:382, SEQ ID NO:384, SEQ ID NO:386, SEQ ID NO:388, SEQ ID NO:390 and SEQ ID NO:392, respectively. The amino acid sequences of the scFvs called SC05-140, SC05-157, SC05-159, SC05-166, SC05-179, SC05-187, SC06-016, SC06-043, SC06-049, SC05-050, SC06-071, SC06-077, SC06-078, SC06-079, SC06-086, SC06-087, SC06-089, SC06-092, SC06-191, SC06-195, SC06-198, SC06-241, SC06-242, SC06-246, SC06-252, SC06-388, SC06-389, SC06-396, SC06-402, SC06-409, SC06-415, SC06-421, SC06-429, and SC06-432 are shown in SEQ ID NO:351, SEQ ID NO:353, SEQ ID NO:62, SEQ ID NO:64, SEQ ID NO:355, SEQ ID NO:66, SEQ ID NO:68, SEQ ID NO:70, SEQ ID NO:72, SEQ ID NO:357, SEQ ID NO:74, SEQ ID NO:359, SEQ ID NO:76, SEQ ID NO:361, SEQ ID NO:363, SEQ ID NO:207, SEQ ID NO:209, SEQ ID NO:365, SEQ ID NO:367, SEQ ID NO:369, SEQ ID NO:371, SEQ ID NO:78, SEQ ID NO:373, SEQ ID NO:375, SEQ ID NO:80, SEQ ID NO:377, SEQ ID NO:379, SEQ ID NO:381, SEQ ID NO:383, SEQ ID NO:385, SEQ ID NO:387, SEQ ID NO:389, SEQ ID NO:391 and SEQ ID NO:393, respectively. The VH and VL gene identity (see Tomlinson I M, Williams S C, Ignatovitch O, Corbett S J, Winter G. V-BASE Sequence Directory. Cambridge United Kingdom: MRC Centre for Protein Engineering (1997)) and CDR sequences of the scFvs specifically binding enterococci are depicted in Tables 10 and 11, respectively.

Example 6

Construction of Fully Human Immunoglobulin Molecules (Human Monoclonal Anti-Enterococcal Antibodies) from the Selected Anti-Enterococcal Single Chain Fvs Heavy and light chain variable regions of the scFv called SC05-140, SC05-157, SC05-159, SC05-166, SC05-179, SC05-187, SC06-016, SC06-043, SC06-049, SC05-050, SC06-071, SC06-077, SC06-078, SC06-079, SC06-086, SC06-087, SC06-089, SC06-092, SC06-191, SC06-195, SC06-198, SC06-241, SC06-242, SC06-246, SC06-252, SC06-388, SC06-389, SC06-396, SC06-402, SC06-409, SC06-415, SC06-421, SC06-429, and SC06-432 were cloned directly by restriction digest for expression in the IgG expression vectors pIg-C911-HCgamma1 (see SEQ ID NO:127), pIg-C909-Ckappa (see SEQ ID NO:128) and pIg-C910-Clambda (see SEQ ID NO:129). The heavy chain variable regions of the scFvs called SC05-140, SC05-157, SC05-159, SC05-166, SC05-179, SC05-187, SC06-016, SC06-043, SC06-049, SC05-050, SC06-071, SC06-077, SC06-078, SC06-079, SC06-086, SC06-087, SC06-089, SC06-092, SC06-191, SC06-195, SC06-198, SC06-241, SC06-242, SC06-246, SC06-252, SC06-388, SC06-389, SC06-396, SC06-402, SC06-409, SC06-415, SC06-421, SC06-429, and SC06-432 were cloned into the vector pIg-C911-HCgamma1 by restriction digest using the enzymes SfiI and XhoI. The light chain variable region of the scFv called SC06-016, SC06-050, SC06-077, SC06-086, SC06-191, SC06-241, SC06-396, and SC06-429 were cloned into the vector pIg-C909-Ckappa by restriction digest using the enzymes SalI, XhoI and NotI. The light chain variable region of the scFv called SC05-140, SC05-157, SC05-159, SC05-166, SC05-179, SC05-187, SC06-043, SC06-049, SC06-071, SC06-078, SC06-079, SC06-087, SC06-089, SC06-092, SC06-195, SC06-198, SC06-242, SC06-246, SC06-252, SC06-388, SC06-389, SC06-402, SC06-409, SC06-415, SC06-421, and SC06-432 were cloned into the vector pIg-C910-Clambda by restriction digest using the enzymes SalI, XhoI and NotI. Thereafter the nucleotide sequences were verified according to standard techniques known to the person skilled in the art.

The resulting expression pgG105-140C911, pgG105-157C911, pgG105-159C911, pgG105-166C911, pgG105-179C911, pgG105-187C911, pgG106-016C911, pgG106-043C911, pgG106-049C911, pgG106-050C911, pgG106-071C911, pgG106-077C911, pgG106-078C911, pgG106-079C911, pgG106-086C911, pgG106-087C911, pgG106-089C911, pgG106-092C911, pgG106-191C911, pgG106-195C911, pgG106-198C911, pgG106-0241C911, pgG106-242C911, pgG106-246C911, pgG106-252C911, pgG106-388C911, pgG106-389C911, pgG106-396C911, pgG106-402C911, pgG106-409C911, pgG106-415C911, pgG106-421C911, pgG106-429C911, and pgG106-432C911 encoding anti-enterococci human IgG1 heavy chains and pgG105-140C910, pgG105-157C910, pgG105-159C910, pgG105-166C910, pgG105-179C910, pgG105-187C910, pgG106-016C909, pgG106-043C910, pgG106-049C910, pgG106-050C909, pgG106-071C910, pgG106-077C909, pgG106-078C910, pgG106-079C910, pgG106-086C909, pgG106-087C910, pgG106-089C910, pgG106-092C910, pgG106-191C909, pgG106-195C910, pgG106-198C910, pgG106-0241C909, pgG106-242C910, pgG106-246C910, pgG106-252C910, pgG106-388C910, pgG106-389C910, pgG106-396C909, pgG106-402C910, pgG106-409C910, pgG106-415C910, pgG106-421C910, pgG106-429C909, and pgG106-432C910 encoding the anti-enterococci human Ig light chains were transiently expressed in combination in 293T cells and supernatants containing human IgG1 antibodies were obtained. The nucleotide sequences of the heavy chains of the antibodies called CR5140, CR5157, CR5159, CR5166, CR5179, CR5187, CR6016, CR6043, CR6049, CR6050, CR6071, CR6077, CR6078, CR6079, CR6086, CR6087, CR6089, CR6092, CR6191, CR6195, CR6198, CR6241, CR6242, CR6246, CR6252, CR6388, CR6389, CR6396, CR6402, CR6409, CR6415, CR6421, CR6429, and CR6432 are shown in SEQ ID NO:394, SEQ ID NO:396, SEQ ID NO:81, SEQ ID NO:83, SEQ ID NO:398, SEQ ID NO:85, SEQ ID NO:87, SEQ ID NO:89, SEQ ID NO:91, SEQ ID NO:400, SEQ ID NO:93, SEQ ID NO:402, SEQ ID NO:95, SEQ ID NO:404, SEQ ID NO:406, SEQ ID NO:210, SEQ ID NO:212, SEQ ID NO:408, SEQ ID NO:410, SEQ ID NO:412, SEQ ID NO:414, SEQ ID NO:97, SEQ ID NO:416, SEQ ID NO:418, SEQ ID NO:99, SEQ ID NO:420, SEQ ID NO:422, SEQ ID NO:424, SEQ ID NO:426, SEQ ID NO:428, SEQ ID NO:430, SEQ ID NO:432, SEQ ID NO:434, and SEQ ID NO:436, respectively. The amino acid sequences of the heavy chains of the antibodies called CR5140, CR5157, CR5159, CR5166, CR5179, CR5187, CR6016, CR6043, CR6049, CR6050, CR6071, CR6077, CR6078, CR6079, CR6086, CR6087, CR6089, CR6092, CR6191, CR6195, CR6198, CR6241, CR6242, CR6246, CR6252, CR6388, CR6389, CR6396, CR6402, CR6409, CR6415, CR6421, CR6429, and CR6432, are shown in SEQ ID NO:395, SEQ ID NO:397, SEQ ID NO:82, SEQ ID NO:84, SEQ ID NO:399, SEQ ID NO:86, SEQ ID NO:88, SEQ ID NO:90, SEQ ID NO:92, SEQ ID NO:401, SEQ ID NO:94, SEQ ID NO:403, SEQ ID NO:96, SEQ ID NO:405, SEQ ID NO:407, SEQ ID NO:211, SEQ ID NO:213, SEQ ID NO:409, SEQ ID NO:411, SEQ ID NO:413, SEQ ID NO:415, SEQ ID NO:98, SEQ ID NO:417, SEQ ID NO:419, SEQ ID NO:100, SEQ ID NO:421, SEQ ID NO:423, SEQ ID NO:425, SEQ ID NO:427, SEQ ID NO:429, SEQ ID NO:431, SEQ ID NO:433, SEQ ID NO:435, and SEQ ID NO:437, respectively.

The nucleotide sequences of the light chain of antibodies CR5140, CR5157, CR5159, CR5166, CR5179, CR5187, CR6016, CR6043, CR6049, CR6050, CR6071, CR6077, CR6078, CR6079, CR6086, CR6087, CR6089, CR6092, CR6191, CR6195, CR6198, CR6241, CR6242, CR6246, CR6252, CR6388, CR6389, CR6396, CR6402, CR6409, CR6415, CR6421, CR6429, and CR6432 are shown in SEQ ID NO:438, SEQ ID NO:440, SEQ ID NO:101, SEQ ID NO:103, SEQ ID NO:442, SEQ ID NO:105, SEQ ID NO:107, SEQ ID NO:109, SEQ ID NO:111, SEQ ID NO:444, SEQ ID NO:113, SEQ ID NO:446, SEQ ID NO:115, SEQ ID NO:448, SEQ ID NO:450, SEQ ID NO:214, SEQ ID NO:216, SEQ ID NO:452, SEQ ID NO:454, SEQ ID NO:456, SEQ ID NO:458, SEQ ID NO:117, SEQ ID NO:460, SEQ ID NO:462, SEQ ID NO:119, SEQ ID NO:464, SEQ ID NO:466, SEQ ID NO:468, SEQ ID NO:470, SEQ ID NO:472, SEQ ID NO:474, SEQ ID NO:476, SEQ ID NO:478, and SEQ ID NO:480, respectively. The amino acid sequences of the light chain of antibodies CR5140, CR5157, CR5159, CR5166, CR5179, CR5187, CR6016, CR6043, CR6049, CR6050, CR6071, CR6077, CR6078, CR6079, CR6086, CR6087, CR6089, CR6092, CR6191, CR6195, CR6198, CR6241, CR6242, CR6246, CR6252, CR6388, CR6389, CR6396, CR6402, CR6409, CR6415, CR6421, CR6429, and CR6432 are shown in SEQ ID NO:439, SEQ ID NO:441, SEQ ID NO:102, SEQ ID NO:104, SEQ ID NO:443, SEQ ID NO:106, SEQ ID NO:108, SEQ ID NO:110, SEQ ID NO:112, SEQ ID NO:445, SEQ ID NO:114, SEQ ID NO:447, SEQ ID NO:116, SEQ ID NO:449, SEQ ID NO:451, SEQ ID NO:215, SEQ ID NO:217, SEQ ID NO:453, SEQ ID NO:455, SEQ ID NO:457, SEQ ID NO:459, SEQ ID NO:118, SEQ ID NO:461, SEQ ID NO:463, SEQ ID NO:120, SEQ ID NO:465, SEQ ID NO:467, SEQ ID NO:469, SEQ ID NO:471, SEQ ID NO:473, SEQ ID NO:475, SEQ ID NO:477, SEQ ID NO:479, and SEQ ID NO:481, respectively. A person skilled in the art can determine the variable regions of the heavy and light chains of the above antibodies by following Kabat et al. (1991) as described in Sequences of Proteins of Immunological Interest. The variable regions of the antibodies are given in Table 12.

The human anti-enterococcal IgG1 antibodies were validated for their ability to bind to enterococci by ELISA essentially as described for scFvs above; IgG1 were assayed at a concentration of 5 g/ml except for the following IgG1s: CR6191 was assayed at 1.6 g/ml, CR6195 at 3.1 g/ml CR6198 at 4.1 g/ml, CR6241 at 2.7 g/ml, CR6246 at 2.6 g/ml and CR6252 at 3.0 g/ml The negative control was an anti-West Nile virus antibody (CR4374). In addition, the human anti-enterococcal IgG1 antibodies were tested for their ability to bind to different clinical isolates of *Enterococcus faecalis* and *Enterococcus faecium* (see Table 13). An antibody was considered to bind to an isolate, when the value within an individual experiment was at least three-fold compared to the value of the negative control within that individual experiment. The value of the negative control in Table 13 is an average of 6 experiments. All antibodies except CR5157, CR5179, CR6016, CR6043, CR6050, CR6246, CR6388, CR6409 and the negative control antibody specifically bound to *Enterococcus faecalis* strain 12030 and all IgG1s with the exception of CR5157, CR6016, CR6043, CR6050, CR6241, CR6242, CR6246, CR6388 and CR6409 bound to more than one clinical isolate. Antibodies CR5187, CR6049, CR6396, CR6402 and CR6421 bound to all *Enterococcus faecalis* strains tested and the two *Enterococcus faecium* strains tested. Alternatively, batches of greater than 1 mg of each antibody were produced and purified using standard procedures.

Example 7

In Vitro Opsonic Phagocytic Activity of Enterococcal Specific IgGs Measured by Opsonophagocytic Killing Assay An opsonophagocytic assay was conducted to quantify the killing activity of anti-enterococci human IgG1 against the enterococcal clinical isolate 12030. Freshly drawn human blood (10 to 30 ml) was mixed with an equal volume of dextran-heparin buffer (4.5 g of dextran, Sigma Chemical, St. Louis; 28.4 mg of heparin sodium in 500 ml of distilled water), and the mixture was incubated at 37° C. for 1 hour. The upper layer containing the leukocytes was collected by centrifugation, and hypotonic lysis of the remaining erythrocytes was accomplished by suspension of the cell pellet in 1% (w/v) $NH_4Cl$. The leukocyte population was subsequently washed in RPMI with 15% fetal bovine serum. Trypan blue staining and counting in a hemocytometer were used to determine the concentration of live leukocytes, and the final leukocyte concentration was adjusted to $2 \times 10^7$ cells/ml. The phagocytosis assay was performed in duplicate with or without 1001 of leukocyte suspension added to 1001 of bacteria (concentration adjusted spectrophotometrically to $2 \times 10^7$ per ml and confirmed by viable counts), 1001 of anti-enterococci human IgG1 diluted in RPMI, and 1001 of baby rabbit complement. The reaction mixture was incubated on a rotor rack at 37° C. for 90 minutes; samples were taken at time 0 and after 90 minutes, diluted in 1% Proteose Peptone (Difco Laboratories, Detroit, Mich.), and plated onto tryptic soy agar plates. The killing activity (%) of the antibodies was calculated as the mean number of CFU surviving in the sample containing leukocytes subtracted from the mean number of CFU surviving in the sample without leukocytes, divided by the latter and amplified by 100. Four concentrations of the anti-enterococci human IgG1 were tested (2500, 250, 25, 2.5 ng/ml) in two independent experiments. Ordinal regression analysis applying the probit model was used to calculate the concentrations required for 50% killing of bacteria in the assay (see Table 14).

Example 8

In Vivo Activity of Enterococcal Specific IgGs in a Murine Sepsis Model

A murine sepsis model of *enterococcus* (see Hufnagel et al. 2004) was used to quantify activity of anti-enterococci human IgG1 in clearing the enterococcal clinical isolate 12030 from the bloodstream. The purified IgG1 molecules CR5159, CR5187, CR6016, CR6043, CR6049, CR6071, CR6089, and CR6241 demonstrated to have in vitro killing activity against *Enterococcus* and one negative control IgG1 having no killing activity against *Enterococcus* were prepared as described above and were injected i.p. (0.5-1 ml in PBS) into groups of eight BALB/c mice at a dose of 15 mg/kg, with the exception of CR6016 and CR6241 which were injected at a dose of 7.5 mg/kg. In addition, one group of mice was injected with PBS. After 24 hours animals were inoculated i.v. with $6 \times 10^8$ CFU of *Enterococcus* strain 12030. Four hours after the bacterial challenge mice received a second i.p. injection of CR5159, CR5187, CR6016, CR6043, CR6049, CR6071, CR6089, and CR6241 at the same dose. Three days after systemic infection animals were euthanised and 0.5 ml of blood collected by cardiac puncture. Blood samples were cultured quantitatively on enterococcal selective agar medium; 1001 of blood diluted in 9001 of THB was spread out onto plates in duplicate. After overnight incubation the number of CFU was read off the plate and multiplied by 10 to give the CFU/ml of blood. This value is directly related to the amount of circulating bacteria at the time of sacrifice.

The primary endpoint in this model is CFU of *Enterococcus* in the blood 3 days after inoculation. As shown in FIG. 1 all of the animals that received PBS or control IgG1 had $>10^2$ CFU/ml of *Enterococcus* in their blood after 3 days and the median was $\sim 10^3$ CFU/ml. In contrast, all of the groups that received anti-enterococcal antibodies contained animals with $<10^2$ CFU/ml of *Enterococcus* in the blood. In addition, in all but one case, CR5187, the median was one log below that of the controls. One antibody, CR6089, had a median below the level of sensitivity in the assay (10 CFU/ml) and in 6 out of 8 animals there was no detectable bacteria in the blood. CR6016 and CR6241 that were used at a lower dose still had medians close to 10 CFU/ml of blood indicating that they are of high potency. Non-parametric analysis of variance (Kruskal-Wallis) established that the differences were highly significant (p<0.001). Pairwise comparisons were performed between the test IgG1 and negative control IgG1 using the Mann-Whitney test with the Bonferroni correction. Antibodies CR5159, CR5187, CR6043, CR6049, CR6089, and CR6241 were all significantly different (p<0.05) to the control antibody, while the median difference of the antibodies CR6043 and CR6071 did not reach significance when compared to the control antibody.

Example 9

IgG1 Competition Assay

To establish whether antibodies in the panel competed for binding to the same target a competition ELISA was developed. The enterococcal strain 12030 was streaked onto a blood agar plate and incubated overnight at 37° C. Colonies were scraped from the plate using 5 ml of a 50 mM carbonate buffer (8 volumes of 0.2 M Na2CO3, 17 volumes of 0.2 M NaHCO3 and 75 volumes of distilled water) and centrifuged for 3 minutes at 4000 rpm. The pellet obtained was resuspended in 500 μl of carbonate buffer, centrifuged again and the pellet was resuspended in 500 μl carbonate buffer. Cell density was determined by measuring OD600 of a dilution series of the bacteria.

The *enterococcus* strain was diluted to a density of $5\times10^9$ cells/ml and 100 μl ($5\times10^8$ cells) per well was coated overnight at 4° C. on Nunc-Immuno Maxisorp F96 plates. After incubation, the wells were washed three times with PBS and blocked for 1 hour at room temperature with 300 μl 2% (v/v) ELK in PBS per well. In separate tubes 25 μl of each scFv-phage maxiprep (produced as above) diluted to subsaturating levels (as determined by ELISA above) was mixed with 25 μl blocking buffer (4% (v/v) ELK in PBS) and 50 μl of IgG1 supernatant diluted to 10 μg/ml in PBS. The mixture was incubated for 20 minutes on ice. After removing the blocking solution from the wells, 100 μl of the mixture was added to each well and incubated for 1 hour at room temperature. Next, the wells were washed three times with PBS/0.01% (v/v) Tween and once with PBS. After washing, 100 μl of anti-M13 HRP (1:5000 in 2% (v/v) ELK in PBS) was added per well and incubated for 60 minutes at room temperature. The wells were washed again and staining was visualized by adding 100 μl OPD-solution to each well. The visualization reaction was stopped after 5-10 minutes by adding 50 μl 1M $H_2SO_4$ to each well and the OD was measured at 492 nm. The experiment was repeated twice with the entire panel of antibodies and the control IgG1 CR4374. The results showed that the antibodies could be divided into several distinct groups. Group A consisted of CR6089 and CR6092; Group B consisted of CR5157, CR5187, CR6043, CR6049, CR6388, CR6389, CR6396, CR6402, CR6409, CR6421, and CR6429; and Group C consisted of CR5159, CR5166, CR6050, CR6077, CR6078, CR6086, and CR6191 and the rest of the antibodies CR5140, CR5179, CR6016, CR6071, CR6079, CR6087, CR6195, CR6198, CR6241, CR6242, CR6246, CR6252, CR6415, and CR6432 did not compete with any other antibody for binding.

Example 10

In Vitro Opsonic Phagocytic Activity of Anti-Enterococcal IgG1 Molecules Against Different *E. faecalis*, *E. faecium* and *S. aureus* Strains Measured by Opsonophagocytic Killing Assay To determine the breadth of killing activity of the anti-enterococcal monoclonal antibody panel, purified batches of IgG1 made as described above were assayed for killing activity in the opsonophagocytic killing assay described above. An additional *E. faecalis* strain, Type 2; two different *E. faecium* clinical isolates, 740220 and 838970; and the *S. aureus* clinical isolate 502 were tested. Eighteen antibodies were chosen from the original panel of 34 based on non-competing binding capacity and potency in the opsonophagocytic killing assay. As shown in Table 15, the chosen panel showed killing activity against the *E. faecium* strains at two concentrations, 2.5 and 0.025 μg/ml, although the activity of CR5140, CR6016 and CR6078 was lower then 20% against strain 838970 at the highest concentration. All but one antibody had measurable activity against *E. faecalis* strain Type 2, although 11 out of 18 antibodies had less then 25% killing activity at the highest concentration tested. Surprisingly, all antibodies of the panel had killing activity against the *S. aureus* strain 502, indicating that the antibodies recognize broadly cross-reactive targets. We tested whether any of the antibodies bind to lipoteichoic acid (LTA) of *S. aureus*, and none of these antibodies appeared to do so. Three of the antibodies (CR6252, CR6415 and CR6421) were tested for opsonic phagocytic killing activity against another *Staphylococcus aureus* strain (Newman), and against a *Staphylococcus epidermidis* strain (RP62A), and all three antibodies tested showed killing activity against these different *Staphylococcus* species and strains.

TABLE 1

Human lambda chain variable region primers (sense).

| Primer name | Primer nucleotide sequence | SEQ ID NO |
|---|---|---|
| HuVL1A-Back | 5'-CAGTCTGTGCTGACT-CAGCCACC-3' | SEQ ID NO: 130 |
| HuVL1B-Back | 5'-CAGTCTGTGYTGACG-CAGCCGCC-3' | SEQ ID NO: 131 |
| HuVL1C-Back | 5'-CAGTCTGTCGTGACG-CAGCCGCC-3' | SEQ ID NO: 132 |
| HuVL2B-Back | 5'-CAGTCTGCCCTGACTCAGC-3' | SEQ ID NO: 133 |
| HuVL3A-Back | 5'-TCCTATGWGCTGACT-CAGCCACC-3' | SEQ ID NO: 134 |
| HuVL3B-Back | 5'-TCTTCTGAGCTGACTCAG-GACCC-3' | SEQ ID NO: 135 |
| HuVL4B-Back | 5'-CAGCYTGTGCTGACTCCAT-C-3' | SEQ ID NO: 136 |
| HuVL5-Back | 5'-CAGGCTGTGCTGACT-CAGCCGTC-3' | SEQ ID NO: 137 |
| HuVL6-Back | 5'-AATTTTATGCTGACT-CAGCCCCA-3' | SEQ ID NO: 138 |
| HuVL7/8-Back | 5'-CAGRCTGTGGTGACYCAG-GAGCC-3' | SEQ ID NO: 139 |
| HuVL9-Back | 5'-CWGCCTGTGCTGACT-CAGCCMCC-3' | SEQ ID NO: 140 |
| HuVL10-Back | 5'-CAGGCAGGGCTGACTCAG-3' | SEQ ID NO: 141 |

TABLE 2

Human kappa chain variable region primers (sense).

| Primer name | Primer nucleotide sequence | SEQ ID NO |
|---|---|---|
| HuVK1B-Back | 5'-GACATCCAGWTGACCCAGTCTC-C-3' | SEQ ID NO: 142 |
| HuVK2-Back | 5'-GATGTTGTGATGACTCAGTCTC-C-3' | SEQ ID NO: 143 |
| HuVK2B2 | 5'-GATATTGTGATGACCCAGACTC-C-3' | SEQ ID NO: 144 |

TABLE 2-continued

Human kappa chain variable region primers (sense).

| Primer name | Primer nucleotide sequence | SEQ ID NO |
|---|---|---|
| HuVK3B-Back | 5'-GAAATTGTGWTGACRCAGTCTCC-3' | SEQ ID NO: 145 |
| HuVK5-Back | 5'-GAAACGACACTCACGCAGTCTCC-3' | SEQ ID NO: 146 |
| HuVK6-Back | 5'-GAAATTGTGCTGACTCAGTCTCC-3' | SEQ ID NO: 147 |

TABLE 3

Human kappa chain variable region primers extended with SalI restriction sites (sense), human kappa chain J-region primers extended with NotI restriction sites (anti-sense), human lambda chain variable region primers extended with SalI restriction sites (sense) and human lambda chain J-region primers extended with NotI restriction sites (anti-sense).

| Primer name | Primer nucleotide sequence | SEQ ID NO |
|---|---|---|
| HuVK1B-Back-SAL | 5'-TGAGCACACAGGTCGACGGACATCCAGWTGACCCAGTCTCC-3' | SEQ ID NO: 148 |
| HuVK2-Back-SAL | 5'-TGAGCACACAGGTCGACGGATGTTGTGATGACTCAGTCTCC-3' | SEQ ID NO: 149 |
| HuVK2B2-SAL | 5'-TGAGCACACAGGTCGACGGATATTGTGATGACCCAGACTCC-3' | SEQ ID NO: 150 |
| HuVK3B-Back-SAL | 5'-TGAGCACACAGGTCGACGGAAATTGTGWTGACRCAGTCTCC-3' | SEQ ID NO: 151 |
| HuVK5-Back-SAL | 5'-TGAGCACACAGGTCGACGGAAACGACACTCACGCAGTCTCC-3' | SEQ ID NO: 152 |
| HuVK6-Back-SAL | 5'-TGAGCACACAGGTCGACGGAAATTGTGCTGACTCAGTCTCC-3' | SEQ ID NO: 153 |
| HuJK1-FOR-NOT | 5'-GAGTCATTCTCGACTTGCGGCCGCACGTTTGATTTCCACCTTGGTCCC-3' | SEQ ID NO: 154 |
| HuJK2-FOR-NOT | 5'-GAGTCATTCTCGACTTGCGGCCGCACGTTTGATCTCCAGCTTGGTCCC-3' | SEQ ID NO: 155 |
| HuJK3-FOR-NOT | 5'-GAGTCATTCTCGACTTGCGGCCGCACGTTTGATATCCAGTTTGGTCCC-3' | SEQ ID NO: 156 |

TABLE 3-continued

Human kappa chain variable region primers extended with SalI restriction sites (sense), human kappa chain J-region primers extended with NotI restriction sites (anti-sense), human lambda chain variable region primers extended with SalI restriction sites (sense) and human lambda chain J-region primers extended with NotI restriction sites (anti-sense).

| Primer name | Primer nucleotide sequence | SEQ ID NO |
|---|---|---|
| HuJK4-FOR-NOT | 5'-GAGTCATTCTCGACTTGCGGCCGACGTTTGATCTCCACCTTGGTCCC-3' | SEQ ID NO: 157 |
| HuJK5-FOR-NOT | 5'-GAGTCATTCTCGACTTGCGGCCGCACGTTTAATCTCCAGTCGTGTCCC-3' | SEQ ID NO: 158 |
| HuVL1A-Back-SAL | 5'-TGAGCACACAGGTCGACGCAGTCTGTGCTGACTCAGCCACC-3' | SEQ ID NO: 159 |
| HuVL1B-Back-SAL | 5'-TGAGCACACAGGTCGACGCAGTCTGTGYTGACGCAGCCGCC-3' | SEQ ID NO: 160 |
| HuVL1C-Back-SAL | 5'-TGAGCACACAGGTCGACGCAGTCTGTCGTGACGCAGCCGCC-3' | SEQ ID NO: 161 |
| HuVL2B-Back-SAL | 5'-TGAGCACACAGGTCGACGCAGTCTGCCCTGACTCAGC-3' | SEQ ID NO: 162 |
| HuVL3A-Back-SAL | 5'-TGAGCACACAGGTCGACGTCCTATGWGCTGACTCAGCCACC-3' | SEQ ID NO: 163 |
| HuVL3B-Back-SAL | 5'-TGAGCACACAGGTCGACGTCTTCTGAGCTGACTCAGGACCC-3' | SEQ ID NO: 164 |
| HuVL4B-Back-SAL | 5'-TGAGCACACAGGTCGACGCAGCYTGTGCTGACTCAATC-3' | SEQ ID NO: 165 |
| HuVL5-Back-SAL | 5'-TGAGCACACAGGTCGACGCAGGCTGTGCTGACTCAGCCGTC-3' | SEQ ID NO: 166 |
| HuVL6-Back-SAL | 5'-TGAGCACACAGGTCGACGAATTTTATGCTGACTCAGCCCCA-3' | SEQ ID NO: 167 |
| HuVL7/8-Back-SAL | 5'-TGAGCACACAGGTCGACGCAGRCTGTGGTGACYCAGGAGCC-3' | SEQ ID NO: 168 |
| HuVL9-Back-SAL | 5'-TGAGCACACAGGTCGACGCWGCCTGTGCTGACTCAGCCMCC-3' | SEQ ID NO: 169 |
| HuVL10-Back-SAL | 5'-TGAGCACACAGGTCGACGCAGGCAGGGCTGACTCAG-3' | SEQ ID NO: 170 |

TABLE 3-continued

Human kappa chain variable region primers extended with SalI restriction sites (sense), human kappa chain J-region primers extended with NotI restriction sites (anti-sense), human lambda chain variable region primers extended with SalI restriction sites (sense) and human lambda chain J-region primers extended with NotI restriction sites (anti-sense).

| Primer name | Primer nucleotide sequence | SEQ ID NO |
|---|---|---|
| HuVL1-FOR-NOT | 5'-GAGTCATTCTCGACTTGC GGCCGCACCTAGGACGGTGAC CTTGGTCCC-3' | SEQ ID NO: 171 |
| HuJL2/3-FOR-NOT | 5'-GAGTCATTCTCGACTTGC GGCCGCACCTAGGACGGTCAG CTTGGTCCC-3' | SEQ ID NO: 172 |
| HuJL7-FOR-NOT | 5'-GAGTCATTCTCGACTTGC GGCCGCACCGAGGACGGTCAG CTGGGTGCC-3' | SEQ ID NO: 173 |

TABLE 4

Percentage of the different light chain products in the final mixture, based on concentrations determined by agarose gel analysis.

| Sense primer | Antisense primer | Product | Percentage |
|---|---|---|---|
| HuVL1A-Back-SAL + HuVL1B-Back-SAL + HuVL1C-Back-SAL | HuJL1-FOR-NOT | L1J1 | 4.20% |
| | HuJL2/3-FOR-NOT | L1J2 | 8.40% |
| | HuJL7-FOR-NOT | L1J3 | 1.40% |
| HuVL2B-Back-SAL | HuJL1-FOR-NOT | L2J1 | 3.00% |
| | HuJL2/3-FOR-NOT | L2J2 | 6.00% |
| | HuJL7-FOR-NOT | L2J3 | 1.00% |
| HuVL3A-Back-SAL | HuJL1-FOR-NOT | L3J1 | 3.00% |
| | HuJL2/3-FOR-NOT | L3J2 | 6.00% |
| | HuJL7-FOR-NOT | L3J3 | 1.00% |
| HuVL3B-Back-SAL | HuJL1-FOR-NOT | L4J1 | 0.30% |
| | HuJL2/3-FOR-NOT | L4J2 | 0.60% |
| | HuJL7-FOR-NOT | L4J3 | 0.10% |
| HuVL4B-Back-SAL | HuJL1-FOR-NOT | L5J1 | 0.30% |
| | HuJL2/3-FOR-NOT | L5J2 | 0.60% |
| | HuJL7-FOR-NOT | L5J3 | 0.10% |
| HuVL5-Back-SAL | HuJL1-FOR-NOT | L6J1 | 0.30% |
| | HuJL2/3-FOR-NOT | L6J2 | 0.60% |
| | HuJL7-FOR-NOT | L6J3 | 0.10% |
| HuVL6-Back-SAL | HuJL1-FOR-NOT | L7J1 | 0.30% |
| | HuJL2/3-FOR-NOT | L7J2 | 0.60% |
| | HuJL7-FOR-NOT | L7J3 | 0.10% |
| HuVL7/8-Back-SAL | HuJL1-FOR-NOT | L8J1 | 0.30% |
| | HuJL2/3-FOR-NOT | L8J2 | 0.60% |
| | HuJL7-FOR-NOT | L8J3 | 0.10% |
| HuVL9-Back-SAL + HuVL10-Back-SAL | HuJL1-FOR-NOT | L9J1 | 0.30% |
| | HuJL2/3-FOR-NOT | L9J2 | 0.60% |
| | HuJL7-FOR-NOT | L9J3 | 0.10% |
| HuVK1B-Back-SAL | HuJK1-FOR-NOT | K1J1 | 7.50% |
| | HuJK2-FOR-NOT | K1J2 | 7.50% |
| | HuJK3-FOR-NOT | K1J3 | 3.00% |
| | HuJK4-FOR-NOT | K1J4 | 7.50% |
| | HuJK5-FOR-NOT | K1J5 | 4.50% |
| HuVK2-Back-SAL | HuJK1-FOR-NOT | K2J1 | 1.00% |
| | HuJK2-FOR-NOT | K2J2 | 1.00% |
| | HuJK3-FOR-NOT | K2J3 | 0.40% |
| | HuJK4-FOR-NOT | K2J4 | 1.00% |
| | HuJK5-FOR-NOT | K2J5 | 0.60% |
| HuVK2B2-SAL | HuJK1-FOR-NOT | K3J1 | 0.25% |
| | HuJK2-FOR-NOT | K3J2 | 0.25% |
| | HuJK3-FOR-NOT | K3J3 | 0.10% |
| | HuJK4-FOR-NOT | K3J4 | 0.25% |
| | HuJK5-FOR-NOT | K3J5 | 0.15% |
| HuVK3B-Back-SAL | HuJK1-FOR-NOT | K4J1 | 4.75% |
| | HuJK2-FOR-NOT | K4J2 | 4.75% |
| | HuJK3-FOR-NOT | K4J3 | 1.90% |
| | HuJK4-FOR-NOT | K4J4 | 4.75% |
| | HuJK5-FOR-NOT | K4J5 | 2.85% |
| HuVK5-Back-SAL | HuJK1-FOR-NOT | K5J1 | 0.25% |
| | HuJK2-FOR-NOT | K5J2 | 0.25% |
| | HuJK3-FOR-NOT | K5J3 | 0.10% |
| | HuJK4-FOR-NOT | K5J4 | 0.25% |
| | HuJK5-FOR-NOT | K5J5 | 0.15% |
| HuVK6-Back-SAL | HuJK1-FOR-NOT | K6J1 | 1.25% |
| | HuJK2-FOR-NOT | K6J2 | 1.25% |
| | HuJK3-FOR-NOT | K6J3 | 0.50% |
| | HuJK4-FOR-NOT | K6J4 | 1.25% |
| | HuJK5-FOR-NOT | K6J5 | 0.75% |

TABLE 5

Human IgG heavy chain variable region primers (sense).

| Primer name | Primer nucleotide sequence | SEQ ID NO |
|---|---|---|
| HuVH1B/7A-Back | 5'-CAGRTGCAGCTGGTG-CART CTGG-3' | SEQ ID NO: 174 |
| HuVH1C-Back | 5'-SAGGTCCAGCTGGTR-CAGT CTGG-3' | SEQ ID NO: 175 |
| HuVH2B-Back | 5'-CAGRTCACCTTGAAG-GAGT CTGG-3' | SEQ ID NO: 176 |
| HuVH3A-Back | 5'-GAGGTGCAGCTGGTGGA G-3' | SEQ ID NO: 177 |
| HuVH3C-Back | 5'-GAGGTGCAGCTGGTG-GAGW CYGG-3' | SEQ ID NO: 178 |
| HuVH4B-Back | 5'-CAGGTGCAGCTACAG-CAGT GGGG-3' | SEQ ID NO: 179 |
| HuVH4C-Back | 5'-CAGSTGCAGCTGCAG-GAGT CSGG-3' | SEQ ID NO: 180 |
| HuVH6A-Back | 5'-CAGGTACAGCTGCAG-CAGT CAGG-3' | SEQ ID NO: 181 |

TABLE 6

Human IgG heavy chain variable region primers extended with SfiI/NcoI restriction sites (sense) and human IgG heavy chain J-region primers extended with XhoI/BstEII restriction sites (anti-sense).

| Primer name | Primer nucleotide sequence | SEQ ID NO |
|---|---|---|
| HuVH1B/7A-Back-Sfi | 5'-GTCCTCGCAACTGCGGCC CAGCCGGCCATGGCCCAGRTG CAGCTGGTGCARTCTGG-3' | SEQ ID NO: 182 |

TABLE 6-continued

Human IgG heavy chain variable region primers extended with SfiI/NcoI restriction sites (sense) and human IgG heavy chain J-region primers extended with XhoI/BstEII restriction sites (anti-sense).

| Primer name | Primer nucleotide sequence | SEQ ID NO |
|---|---|---|
| HuVH1C-Back-Sfi | 5'-GTCCTCGCAACTGCGGCC CAGCCGGCCATGGCCSAGGTC CAGCTGGTRCAGTCTGG-3' | SEQ ID NO: 183 |
| HuVH2B-Back-Sfi | 5'-GTCCTCGCAACTGCGGCC CAGCCGGCCATGGCCCAGRTC ACCTTGAAGGAGTCTGG-3' | SEQ ID NO: 184 |
| HuVH3A-Back-Sfi | 5'-GTCCTCGCAACTGCGGCC CAGCCGGCCATGGCCGAGGTG CAGCTGGTGGAG-3' | SEQ ID NO: 185 |
| HuVH3C-Back-Sfi | 5'-GTCCTCGCAACTGCGGCC CAGCCGGCCATGGCCGAGGTG CAGCTGGTGGAGWCYGG-3' | SEQ ID NO: 186 |
| HuVH4B-Back-Sfi | 5'-GTCCTCGCAACTGCGGCC CAGCCGGCCATGGCCCAGGTG CAGCTACAGCAGTGGGG-3' | SEQ ID NO: 187 |
| HuVH4C-Back-Sfi | 5'-GTCCTCGCAACTGCGGCC CAGCCGGCCATGGCCCAGSTG CAGCTGCAGGAGTCSGG-3' | SEQ ID NO: 188 |
| HuVH6A-Back-Sfi | 5'-GTCCTCGCAACTGCGGCC CAGCCGGCCATGGCCCAGGTA CAGCTGCAGCAGTCAGG-3' | SEQ ID NO: 189 |
| HuJH1/2-FOR-XhoIB | 5'-GAGTCATTCTCGACTCGA GACRGTGACCAGGGTGCC-3' | SEQ ID NO: 190 |
| HuJH3-FOR-Xho | 5'-GAGTCATTCTCGACTCGA GACGGTGACCATTGTCCC-3' | SEQ ID NO: 191 |
| HuJH4/5-FOR-Xho | 5'-GAGTCATTCTCGACTCGA GACGGTGACCAGGGTTCC-3' | SEQ ID NO: 192 |
| HuJH6-FOR-Xho | 5'-GAGTCATTCTCGACTCGA GACGGTGACCGTGGTCCC-3' | SEQ ID NO: 193 |

TABLE 7

Percentage of the different heavy chain products in the final mixture.

| Sense primer | Antisense primer | Product | Percentage |
|---|---|---|---|
| HuVH1B/7A-Back-Sfi + HuVH1C-Back-Sfi | HuJH1/2-FOR-XhoIB | H1J1 | 2.5% |
| | HuJH3-FOR-Xho | H1J2 | 2.5% |
| | HuJH4/5-FOR-Xho | H1J3 | 15.0% |
| | HuJH6-FOR-Xho | H1J4 | 5.0% |
| HuVH2B-Back-Sfi | HuJH1/2-FOR-XhoIB | H2J1 | 0.2% |
| | HuJH3-FOR-Xho | H2J2 | 0.2% |
| | HuJH4/5-FOR-Xho | H2J3 | 1.2% |
| | HuJH6-FOR-Xho | H2J4 | 0.4% |
| HuVH3A-Back-Sfi | HuJH1/2-FOR-XhoIB | H3J1 | 2.5% |
| | HuJH3-FOR-Xho | H3J2 | 2.5% |
| | HuJH4/5-FOR-Xho | H3J3 | 15.0% |
| | HuJH6-FOR-Xho | H3J4 | 5.0% |
| HuVH3C-Back-Sfi | HuJH1/2-FOR-XhoIB | H4J1 | 2.5% |
| | HuJH3-FOR-Xho | H4J2 | 2.5% |
| | HuJH4/5-FOR-Xho | H4J3 | 15.0% |
| | HuJH6-FOR-Xho | H4J4 | 5.0% |
| HuVH4B-Back-Sfi | HuJH1/2-FOR-XhoIB | H5J1 | 0.2% |
| | HuJH3-FOR-Xho | H5J2 | 0.2% |
| | HuJH4/5-FOR-Xho | H5J3 | 1.2% |
| | HuJH6-FOR-Xho | H5J4 | 0.4% |
| HuVH4C-Back-Sfi | HuJH1/2-FOR-XhoIB | H6J1 | 2.0% |
| | HuJH3-FOR-Xho | H6J2 | 2.0% |
| | HuJH4/5-FOR-Xho | H6J3 | 12.0% |
| | HuJH6-FOR-Xho | H6J4 | 4.0% |
| HuVH6A-Back-Sfi | HuJH1/2-FOR-XhoIB | H7J1 | 0.1% |
| | HuJH3-FOR-Xho | H7J2 | 0.1% |
| | HuJH4/5-FOR-Xho | H7J3 | 0.6% |
| | HuJH6-FOR-Xho | H7J4 | 0.2% |

TABLE 8

Enterococcal strains used for selection and screening of anti-enterococcal single-chain (scFv) phage antibodies.

| Strain | Source |
|---|---|
| E. faecalis 12030 | Veterans Administration Hospital, Cleveland, Ohio |
| E. faecalis T2 | Prototype Japanese strain |
| E. faecalis 6814 | Brigham and Women's Hospital, Boston, Massachusetts |
| E. faecalis B8610A | Brigham and Women's Hospital, Boston, Massachusetts |
| E. faecium 740220 | Brigham and Women's Hospital, Boston, Massachusetts |
| E. faecium B210860 | Brigham and Women's Hospital, Boston, Massachusetts |

TABLE 9

Enterococcal specific binding activity of single-chain (scFv) phage antibodies as measured by ELISA.

| Name phage antibody | Enterococcus strains (OD492 nm) | | Control antigens (OD492 nm) | |
|---|---|---|---|---|
| | 12030 | T2 | BSA | ELK |
| SC05-140 | 1.094 | ND | 0.226 | 0.152 |
| SC05-157 | 0.787 | ND | 0.058 | 0.106 |
| SC05-159 | 0.612 | ND | 0.060 | 0.089 |
| SC05-166 | 0.954 | ND | 0.104 | 0.099 |
| SC05-179 | 0.804 | ND | 0.045 | 0.047 |
| SC05-187 | 0.835 | 1.043 | 0.055 | 0.055 |
| SC06-016 | 0.842 | ND | 0.044 | 0.041 |
| SC06-043 | 0.705 | ND | 0.045 | 0.042 |
| SC06-049 | 0.241 | ND | 0.042 | 0.043 |
| SC06-050 | 0.410 | ND | 0.043 | 0.043 |
| SC06-071 | 0.703 | 0.746 | 0.043 | 0.042 |
| SC06-077 | 0.577 | 1.005 | 0.044 | 0.060 |
| SC06-078 | 0.596 | 1.040 | 0.073 | 0.044 |
| SC06-079 | 0.663 | 0.953 | 0.048 | 0.041 |
| SC06-086 | 0.587 | ND | 0.062 | 0.053 |
| SC06-087 | 0.553 | ND | 0.044 | 0.060 |
| SC06-089 | 0.613 | ND | 0.042 | 0.063 |
| SC06-092 | 0.624 | ND | 0.047 | 0.050 |
| SC06-191 | 0.456 | 0.498 | 0.044 | 0.039 |
| SC06-195 | 0.661 | 0.789 | 0.046 | 0.043 |
| SC06-198 | 0.999 | 1.169 | 0.049 | 0.044 |
| SC06-241 | 1.107 | 0.122 | 0.052 | 0.045 |
| SC06-242 | 0.814 | 0.085 | 0.043 | 0.043 |
| SC06-246 | 0.588 | 0.636 | 0.042 | 0.040 |
| SC06-252 | 0.638 | 0.304 | 0.044 | 0.039 |
| SC06-388 | 1.006 | 1.301 | ND | 0.040 |
| SC06-389 | 1.337 | 1.743 | ND | 0.038 |
| SC06-396 | 0.689 | 1.166 | ND | 0.067 |
| SC06-402 | 1.538 | 1.905 | ND | 0.126 |
| SC06-409 | 0.876 | 1.339 | 0.055 | 0.051 |
| SC06-415 | 0.889 | 1.565 | 0.044 | 0.049 |
| SC06-421 | 3.150 | 3.270 | 0.607 | 0.133 |

TABLE 9-continued

Enterococcal specific binding activity of single-chain (scFv) phage antibodies as measured by ELISA.

| Name phage antibody | Enterococcus strains (OD492 nm) | | Control antigens (OD492 nm) | |
|---|---|---|---|---|
| | 12030 | T2 | BSA | ELK |
| SC06-429 | 1.101 | 2.453 | 0.068 | 0.043 |
| SC06-432 | 0.807 | 2.401 | 0.059 | 0.044 |
| Average neg. ctrl | 0.12 | 0.15 | 0.07 | 0.06 |

ND means not determined

TABLE 10

Data of the *Enterococcus* specific single-chain Fvs.

| Name scFv | SEQ ID NO of nucl. sequence | SEQ ID NO of amino acid sequence* | VH-locus | VL-locus |
|---|---|---|---|---|
| SC05-140 | 350 | 351 (Vh 1-121; Vl 138-243) | Vh3 (3-33) | Vl 3 (3h-V2-14) |
| SC05-157 | 352 | 353 (Vh 1-121; Vl 138-247) | Vh5 (5-51) | Vl 1 (1c-V1-16) |
| SC05-159 | 61 | 62 (Vh 1-123; Vl 140-249) | VH1 (1-f) | Vl 1 (1c-V1-16) |
| SC05-166 | 63 | 64 (Vh 1-133; Vl 150-259) | VH1 (1-18) | Vl 6 (6a-V1-22) |
| SC05-179 | 354 | 355 (Vh 1-117; Vl 134-244) | Vh3 (3-11) | Vl 2 (2e-V1-03) |
| SC05-187 | 65 | 66 (Vh 1-121; Vl 138-246) | VH5 (5-51) | Vl 7 (7a-V3-02) |
| SC06-016 | 67 | 68 (Vh 1-118; Vl 135-241) | VH1 (1-18) | Vk I (L5-DPK5) |
| SC06-043 | 69 | 70 (Vh 1-123; Vl 140-249) | VH5 (5-51) | Vl 2 (2c-V1-02) |
| SC06-049 | 71 | 72 (Vh 1-120; Vl 137-246) | VH5 (5-51) | Vl 2 (2a2-V1-04) |
| SC06-050 | 356 | 357 (Vh 1-126; Vl 143-249) | Vh1 (1-18) | Vk I (L8-DPK8) |
| SC06-071 | 73 | 74 (Vh 1-122; Vl 139-248) | VH3 (3-33) | Vl 2 (2a2-V1-04) |
| SC06-077 | 358 | 359 (Vh 1-119; Vl 136-248) | Vh1 (1-69) | Vk IV (B3-DPK24) |
| SC06-078 | 75 | 76 (Vh 1-119; Vl 136-245) | VH1 (1-69) | Vl 2 (2a2-V1-04) |
| SC06-079 | 360 | 361 (Vh 1-116; Vl 133-242) | Vh3 (3-23) | Vl 1 (1g-V1-17) |
| SC06-086 | 362 | 363 (Vh 1-120; Vl 137-243) | Vh1 (1-69) | Vk I (O12/O2-DPK9) |
| SC06-087 | 206 | 207 (Vh 1-122; Vl 139-249) | Vh3 (3-21) | Vl 2 (2a2-V1-04) |
| SC06-089 | 208 | 209 (Vh 1-123; Vl 140-247) | Vh3 (3-48) | Vl 3 (3h-V2-14) |
| SC06-092 | 364 | 365 (Vh 1-121; Vl 138-248) | Vh3 (3-49) | Vl 2 (2a2-V1-04) |
| SC06-191 | 366 | 367 (Vh 1-120; Vl 137-243) | Vh3 (3-33) | Vk I (L12) |
| SC06-195 | 368 | 369 (Vh 1-115; Vl 132-241) | Vh3 (3-33) | Vl 1 (1g-V1-17) |
| SC06-198 | 370 | 371 (Vh 1-116; Vl 133-243) | Vh4 (4-b) | Vl 1 (1e-V1-13) |
| SC06-241 | 77 | 78 (Vh 1-118; Vl 135-241) | VH3 (3-30.3) | Vk I (L5-DPK5) |
| SC06-242 | 372 | 373 (Vh 1-115; Vl 132-237) | Vh4 (4-59) | Vl 3 (3h-V2-14) |
| SC06-246 | 374 | 375 (Vh 1-121; Vl 138-245) | Vh3 (3-53) | Vl 3 (3h-V2-14) |
| SC06-252 | 79 | 80 (Vh 1-115; Vl 132-241) | VH3 (3-23) | Vl 1 (1c-V1-16) |
| SC06-388 | 376 | 377 (Vh 1-119; Vl 136-245) | Vh5 (5-51) | Vl 2 (2c-V1-02) |
| SC06-389 | 378 | 379 (Vh 1-121; Vl 138-245) | Vh5 (5-51) | Vl 3 (31-V2-13) |
| SC06-396 | 380 | 381 (Vh 1-121; Vl 138-245) | Vh5 (5-51) | Vk III (A27-DPK22) |
| SC06-402 | 382 | 383 (Vh 1-127; Vl 144-255) | Vh5 (5-51) | Vl 2 (2e-V1-03) |
| SC06-409 | 384 | 385 (Vh 1-122; Vl 139-249) | Vh5 (5-51) | Vl 2 (2a2-V1-04) |
| SC06-415 | 386 | 387 (Vh 1-116; Vl 133-242) | Vh3 (3-09) | Vl 2 (2c-V1-02) |
| SC06-421 | 388 | 389 (Vh 1-120; Vl 137-246) | Vh5 (5-51) | Vl 2 (2c-V1-02) |
| SC06-429 | 390 | 391 (Vh 1-121; Vl 138-249) | Vh5 (5-51) | Vk II (A19/A03-DPK15) |
| SC06-432 | 392 | 393 (Vh 1-120; Vl 137-246) | Vh4 (4-31) | Vl 1 (1e-V1-13) |

*between brackets the amino acids making up the heavy chain variable region (VH) and the light chain variable region (VL) is shown

TABLE 11

Data of the CDR regions of the *Enterococcus* specific single-chain Fvs.

| Name scFv | HCDR1 (SEQ ID NO:) | HCDR2 (SEQ ID NO:) | HCDR3 (SEQ ID NO:) | LCDR1 (SEQ ID NO:) | LCDR2 (SEQ ID NO:) | LCDR3 (SEQ ID NO:) |
|---|---|---|---|---|---|---|
| SC05-140 | 218 | 219 | 220 | 221 | 222 | 223 |
| SC05-157 | 224 | 225 | 226 | 227 | 228 | 229 |
| SC05-159 | 1 | 2 | 3 | 4 | 5 | 6 |
| SC05-166 | 7 | 8 | 9 | 10 | 11 | 12 |
| SC05-179 | 230 | 231 | 232 | 233 | 234 | 235 |
| SC05-187 | 13 | 14 | 15 | 16 | 17 | 18 |
| SC06-016 | 19 | 20 | 21 | 22 | 23 | 24 |
| SC06-043 | 25 | 26 | 27 | 28 | 29 | 30 |
| SC06-049 | 31 | 32 | 33 | 34 | 35 | 36 |
| SC06-050 | 236 | 237 | 238 | 239 | 240 | 241 |
| SC06-071 | 37 | 38 | 39 | 40 | 41 | 42 |
| SC06-077 | 242 | 243 | 244 | 245 | 246 | 247 |
| SC06-078 | 43 | 44 | 45 | 46 | 47 | 48 |
| SC06-079 | 248 | 249 | 250 | 251 | 252 | 253 |
| SC06-086 | 254 | 255 | 256 | 257 | 258 | 259 |
| SC06-087 | 194 | 195 | 196 | 197 | 198 | 199 |
| SC06-089 | 200 | 201 | 202 | 203 | 204 | 205 |
| SC06-092 | 260 | 261 | 262 | 263 | 264 | 265 |
| SC06-191 | 266 | 267 | 268 | 269 | 270 | 271 |
| SC06-195 | 272 | 273 | 274 | 275 | 276 | 277 |
| SC06-198 | 278 | 279 | 280 | 281 | 282 | 283 |
| SC06-241 | 49 | 50 | 51 | 52 | 53 | 54 |
| SC06-242 | 284 | 285 | 286 | 287 | 288 | 289 |
| SC06-246 | 290 | 291 | 292 | 293 | 294 | 295 |
| SC06-252 | 55 | 56 | 57 | 58 | 59 | 60 |
| SC06-388 | 296 | 297 | 298 | 299 | 300 | 301 |
| SC06-389 | 302 | 303 | 304 | 305 | 306 | 307 |
| SC06-396 | 308 | 309 | 310 | 311 | 312 | 313 |
| SC06-402 | 314 | 315 | 316 | 317 | 318 | 319 |
| SC06-409 | 320 | 321 | 322 | 323 | 324 | 325 |
| SC06-415 | 326 | 327 | 328 | 329 | 330 | 331 |
| SC06-421 | 332 | 333 | 334 | 335 | 336 | 337 |
| SC06-429 | 338 | 339 | 340 | 341 | 342 | 343 |
| SC06-432 | 344 | 345 | 346 | 347 | 348 | 349 |

TABLE 12

Data of the *Enterococcus* specific IgGs.

| Name IgG | SEQ ID NO of nucl. sequence heavy chain | SEQ ID NO of amino acid sequence* heavy chain | SEQ ID NO of nucl. sequence light chain | SEQ ID NO of amino acid sequence* light chain |
|---|---|---|---|---|
| CR5140 | 394 | 395 (Vh 1-121) | 438 | 439 (Vl 1-106) |
| CR5157 | 396 | 397 (Vh 1-121) | 440 | 441 (Vl 1-110) |
| CR5159 | 81 | 82 (Vh 1-123) | 101 | 102 (Vl 1-110) |
| CR5166 | 83 | 84 (Vh 1-133) | 103 | 104 (Vl 1-110) |
| CR5179 | 398 | 399 (Vh 1-117) | 442 | 443 (Vl 1-111) |
| CR5187 | 85 | 86 (Vh 1-121) | 105 | 106 (Vl 1-109) |
| CR6016 | 87 | 88 (Vh 1-118) | 107 | 108 (Vl 1-107) |
| CR6043 | 89 | 90 (Vh 1-123) | 109 | 110 (Vl 1-110) |
| CR6049 | 91 | 92 (Vh 1-120) | 111 | 112 (Vl 1-110) |
| CR6050 | 400 | 401 (Vh 1-126) | 444 | 445 (Vl 1-107) |
| CR6071 | 93 | 94 (Vh 1-122) | 113 | 114 (Vl 1-110) |
| CR6077 | 402 | 403 (Vh 1-119) | 446 | 447 (Vl 1-133) |
| CR6078 | 95 | 96 (Vh 1-119) | 115 | 116 (Vl 1-110) |
| CR6079 | 404 | 405 (Vh 1-116) | 448 | 449 (Vl 1-110) |
| CR6086 | 406 | 407 (Vh 1-120) | 450 | 451 (Vl 1-107) |
| CR6087 | 210 | 211 (Vh 1-122) | 214 | 215 (Vl 1-111) |
| CR6089 | 212 | 213 (Vh 1-123) | 216 | 217 (Vl 1-108) |
| CR6092 | 408 | 409 (Vh 1-121) | 452 | 453 (Vl 1-111) |
| CR6191 | 410 | 411 (Vh 1-120) | 454 | 455 (Vl 1-107) |
| CR6195 | 412 | 413 (Vh 1-115) | 456 | 457 (Vl 1-110) |
| CR6198 | 414 | 415 (Vh 1-116) | 458 | 459 (Vl 1-111) |
| CR6241 | 97 | 98 (Vh 1-118) | 117 | 118 (Vl 1-107) |
| CR6242 | 416 | 417 (Vh 1-115) | 460 | 461 (Vl 1-106) |
| CR6246 | 418 | 419 (Vh 1-121) | 462 | 463 (Vl 1-108) |
| CR6252 | 99 | 100 (Vh 1-115) | 119 | 120 (Vl 1-110) |
| CR6388 | 420 | 421 (Vh 1-119) | 464 | 465 (Vl 1-110) |

TABLE 12-continued

Data of the *Enterococcus* specific IgGs.

| Name IgG | SEQ ID NO of nucl. sequence heavy chain | SEQ ID NO of amino acid sequence* heavy chain | SEQ ID NO of nucl. sequence light chain | SEQ ID NO of amino acid sequence* light chain |
|---|---|---|---|---|
| CR6389 | 422 | 423 (Vh 1-121) | 466 | 467 (Vl 1-108) |
| CR6396 | 424 | 425 (Vh 1-121) | 468 | 469 (Vl 1-108) |
| CR6402 | 426 | 427 (Vh 1-127) | 470 | 471 (Vl 1-112) |
| CR6409 | 428 | 429 (Vh 1-122) | 472 | 473 (Vl 1-111) |
| CR6415 | 430 | 431 (Vh 1-116) | 474 | 475 (Vl 1-110) |
| CR6421 | 432 | 433 (Vh 1-120) | 476 | 477 (Vl 1-110) |
| CR6429 | 434 | 435 (Vh 1-121) | 478 | 479 (Vl 1-112) |
| CR6432 | 436 | 437 (Vh 1-120) | 480 | 481 (Vl 1-110) |

*between brackets the amino acids making up the heavy chain variable region (VH) and the light chain variable region (VL) is shown

TABLE 13

Specific binding activity against different strains of *Enterococcus faecalis* and *Enterococcus faecium* by human IgG1 antibodies as measured by ELISA.

| Antibody Name | 12030 | T2 | 6814 | B8610A | 740220* | B210860* |
|---|---|---|---|---|---|---|
| CR5140 | 3.084 | 0.185 | 0.121 | 1.769 | 0.185 | 0.123 |
| CR5157 | 0.225 | 0.358 | 0.215 | 0.282 | 0.199 | 0.086 |
| CR5159 | 0.383 | 0.441 | 0.265 | 0.134 | 0.114 | 0.077 |
| CR5166 | 0.533 | 1.387 | 0.444 | 0.140 | 0.170 | 0.101 |
| CR5179 | 0.250 | 1.206 | 0.285 | 1.546 | 0.131 | 0.091 |
| CR5187 | 0.869 | 1.267 | 0.939 | 1.269 | 0.725 | 0.296 |
| CR6016 | 0.281 | 0.622 | 0.243 | 0.134 | 0.126 | 0.084 |
| CR6043 | 0.232 | 0.326 | 0.203 | 0.274 | 0.196 | 0.101 |
| CR6049 | 0.779 | 1.258 | 1.123 | 0.992 | 0.509 | 0.251 |
| CR6050 | 0.291 | 0.739 | 0.218 | 0.117 | 0.138 | 0.092 |
| CR6071 | 1.452 | 0.391 | 0.699 | 0.629 | 0.109 | 0.081 |
| CR6077 | 0.739 | 1.774 | 0.436 | 0.137 | 0.137 | 0.086 |
| CR6078 | 0.482 | 1.457 | 0.336 | 0.143 | 0.114 | 0.082 |
| CR6079 | 0.751 | 0.597 | 0.293 | 1.160 | 0.186 | 0.114 |
| CR6086 | 0.583 | 1.554 | 0.335 | 0.118 | 0.116 | 0.080 |
| CR6087 | 1.085 | 1.414 | 0.098 | 0.135 | 0.182 | 0.091 |
| CR6089 | 2.164 | 0.309 | 1.127 | 0.822 | 0.118 | 0.085 |
| CR6092 | 2.779 | 1.204 | 1.989 | 1.599 | 0.113 | 0.088 |
| CR6191 | 0.868 | 1.639 | 0.475 | 0.100 | 0.063 | 0.043 |
| CR6195 | 0.304 | 1.652 | 0.084 | 2.219 | 0.051 | 0.042 |
| CR6198 | 1.151 | 2.854 | 0.532 | 2.849 | 0.071 | 0.039 |
| CR6241 | 0.814 | 0.091 | 0.043 | 0.072 | 0.060 | 0.037 |
| CR6242 | 0.356 | 0.102 | 0.047 | 0.075 | 0.079 | 0.038 |
| CR6246 | 0.207 | 0.290 | 0.047 | 0.083 | 0.131 | 0.049 |
| CR6252 | 0.583 | 0.370 | 0.045 | 0.076 | 0.690 | 0.052 |
| CR6388 | 0.165 | 0.180 | 0.139 | 0.157 | 0.207 | 0.116 |
| CR6389 | 0.562 | 0.197 | 0.122 | 0.182 | 0.168 | 0.320 |
| CR6396 | 0.427 | 0.640 | 0.342 | 0.500 | 0.456 | 0.312 |
| CR6402 | 0.428 | 0.391 | 0.236 | 0.447 | 0.292 | 0.270 |
| CR6409 | 0.120 | 0.155 | 0.113 | 0.145 | 0.169 | 0.124 |
| CR6415 | 2.284 | 1.910 | 0.122 | 0.108 | 1.119 | 0.195 |
| CR6421 | 0.693 | 0.803 | 0.511 | 0.822 | 0.438 | 0.368 |
| CR6429 | 0.302 | 0.437 | 0.190 | 0.403 | 0.347 | 0.185 |
| CR6432 | 0.358 | 0.364 | 0.322 | 0.500 | 0.216 | 0.406 |
| Average neg. ctrl | 0.11 | 0.13 | 0.09 | 0.13 | 0.12 | 0.07 |

TABLE 14

In vitro opsonophagocytic killing activity against *Enterococcus faecalis* strain 12030 by human IgG1 antibodies.

| Antibody Name | Antibody Concentrations (ng/ml) giving 50% bacterial killing |
|---|---|
| CR5140 | ND |
| CR5157 | 20.7 |
| CR5159 | 130 |
| CR5166 | 27.8 |
| CR5179 | 312 |
| CR5187 | 295 |
| CR6016 | 2.20 |
| CR6043 | 8.94 |
| CR6049 | 3794 |
| CR6050 | 5.82 |
| CR6071 | 12.4 |
| CR6077 | 54.7 |
| CR6078 | 10.5 |
| CR6079 | >10000 |
| CR6086 | 10.8 |
| CR6087 | 21.2 |
| CR6089 | 3.67 |
| CR6092 | >10000 |
| CR6191 | 178 |
| CR6195 | >10000 |
| CR6198 | 4787 |
| CR6241 | 0.613 |
| CR6242 | ND |
| CR6246 | >10000 |
| CR6252 | 29.2 |
| CR6388 | 0.64 |
| CR6389 | 0.33 |
| CR6396 | 4.71 |
| CR6402 | 1.00 |
| CR6409 | 36.6 |
| CR6415 | ND |
| CR6421 | 21.6 |
| CR6429 | 1.2 |
| CR6432 | >10000 |

ND means not determined

TABLE 15

Killing activity of IgG1 antibodies as measured by opsonophagocytic killing assay.

| | Mean enterococcal and staphylococcal killing activity (%) Strain | | | | | | | |
|---|---|---|---|---|---|---|---|---|
| | Type 2 | | 740220 | | 838970 | | 502 | |
| | [ng/ml] | | | | | | | |
| IgG1 antibody | 2500 | 25 | 2500 | 25 | 2500 | 25 | 2500 | 25 |
| CR5140 | 14.9 | 7.7 | 72.2 | 44.1 | 11.9 | 2.3 | 66.4 | 44.9 |
| CR5157 | 2.3 | 4.0 | 64.8 | 14.5 | 27.7 | 9.7 | 48.7 | 27.0 |
| CR6016 | 15.7 | 4.6 | 66.9 | 17.9 | 3.2 | 1.7 | 59.0 | 32.3 |
| CR6043 | 30.0 | 16.1 | 63.6 | 15.7 | 21.1 | 2.8 | 50.5 | 21.3 |
| CR6050 | 7.5 | 5.8 | 49.4 | 18.8 | 33.1 | 8.1 | 59.0 | 28.2 |
| CR6078 | 43.2 | 24.9 | 60.4 | 25.6 | 4.6 | 1.5 | 39.2 | 12.8 |
| CR6087 | 54.4 | 41.1 | 58.8 | 30.3 | 34.7 | 16.0 | 26.5 | 12.3 |
| CR6089 | 7.3 | 6.3 | 60.4 | 19.4 | 32.2 | 7.4 | 32.8 | 8.2 |
| CR6241 | 6.5 | 4.3 | 73.5 | 44.8 | 48.5 | 18.3 | 38.2 | 9.6 |
| CR6252 | 9.8 | 6.9 | 74.6 | 43.6 | 43.1 | 25.5 | 46.5 | 19.7 |
| CR6388 | 50.8 | 22.6 | 54.8 | 18.0 | 47.2 | 7.3 | 51.8 | 34.1 |
| CR6389 | 10.5 | 7.7 | 56.8 | 30.8 | 37.7 | 19.3 | 35.4 | 16.7 |
| CR6396 | 6.8 | 2.9 | 36.6 | 9.4 | 30.9 | 5.2 | 37.6 | 13.1 |
| CR6402 | 39.0 | 24.9 | 57.9 | 21.0 | 36.4 | 12.9 | 20.8 | 6.0 |
| CR6409 | 46.0 | 27.6 | 64.5 | 36.9 | 25.0 | 3.7 | 46.9 | 18.4 |
| CR6415 | 16.9 | 12.2 | 56.6 | 24.2 | 35.3 | 19.6 | 42.4 | 20.4 |
| CR6421 | 5.3 | 2.9 | 64.3 | 14.0 | 35.7 | 21.0 | 44.9 | 21.5 |
| CR6429 | −0.1 | −1.2 | 58.7 | 5.7 | 43.5 | 12.3 | 36.5 | 12.6 |

REFERENCES

Boel E, Verlaan S, Poppelier M J, Westerdaal N A, Van Strijp J A and Logtenberg T (2000), Functional human monoclonal antibodies of all isotypes constructed from phage display library-derived single-chain Fv antibody fragments. J. Immunol. Methods 239:153-166.

Burton D R and Barbas C F (1994), Human antibodies from combinatorial libraries. Adv. Immunol. 57:191-280.

Chou, T C and P Talalay (1984), Quantitative analysis of dose-effect relationships: the combined effects of multiple drugs or enzyme inhibitors. Adv. Enzyme Regul. 22:27-55.

De Kruif J, Terstappen L, Boel E and Logtenberg T (1995a), Rapid selection of cell subpopulation-specific human monoclonal antibodies from a synthetic phage antibody library. Proc. Natl. Acad. Sci. USA 92:3938.

De Kruif J, Boel E and Logtenberg T (1995b), Selection and application of human single-chain Fv antibody fragments from a semi-synthetic phage antibody display library with designed CDR3 regions. J. Mol. Biol. 248:97-105.

Huebner J, Wang Y, Krueger W A, Madoff L C, Martirosian G, Boisot S, Goldmann D A, Kasper D L, Tzianabos A O and Pier G B (1999), Isolation and chemical characterization of a capsular polysaccharide antigen shared by clinical isolates of *Enterococcus faecalis* and vancomycin-resistant *Enterococcus faecium*. Infect. Immun. 67:1213-1219.

Hufnagel M, Koch S, Creti R, Baldassarri L, and Huebner J (2004), A putative sugar-binding transcriptional regulator in a novel gene locus in *Enterococcus faecalis* contributes to production of biofilm and prolonged bacteremia in mice. J. Infect. Dis. 189:420-430.

Huls G, Heijnen I J, Cuomo E, van der Linden J, Boel E, van de Winkel J and Logtenberg T (1999), Antitumor immune effector mechanisms recruited by phage display-derived fully human IgG1 and IgA1 monoclonal antibodies. Cancer Res. 59:5778-5784.

Slootstra J W, Puijk W C, Ligtvoet G J, Langeveld J P, Meloen R H (1996), Structural aspects of antibody-antigen interaction revealed through small random peptide libraries. Mol. Divers. 1:87-96.

SEQUENCE LISTING (481 sequences)

SEQ ID NO: 1 - protein, 5 aa, Homo sapiens
DYYMH

SEQ ID NO: 2 - protein, 17 aa, Homo sapiens
LVDPEDGETIYAEKFQG

SEQ ID NO: 3 - protein, 14 aa, Homo sapiens
AEVMTTINNWYFDL

SEQ ID NO: 4 - protein, 13 aa, Homo sapiens
SGSSSNIGSNNVS

SEQ ID NO: 5 - protein, 7 aa, Homo sapiens
SNNQRPS

SEQ ID NO: 6 - protein, 11 aa, Homo sapiens
AAWDDSLNGWV

SEQ ID NO: 7 - protein, 5 aa, Homo sapiens
SYAIS

SEQ ID NO: 8 - protein, 17 aa, Homo sapiens
WISAYNGNTNYARKLQG

SEQ ID NO: 9 - protein, 24 aa, Homo sapiens
AGLMFTAWFGELWDHGTKDNWFDP

SEQ ID NO: 10 - protein, 13 aa, Homo sapiens
TRSSGSIASYYVQ

SEQ ID NO: 11 - protein, 7 aa, Homo sapiens
EDNQRPS

SEQ ID NO: 12 - protein, 9 aa, Homo sapiens
QSYDSSNQV

SEQ ID NO: 13 - protein, 5 aa, Homo sapiens
KYWIG

SEQ ID NO: 14 - protein, 17 aa, Homo sapiens
IIYPGDSDTRYSPSFQG

SEQ ID NO: 15 - protein, 12 aa, Homo sapiens
GSGIATGNSFDS

SEQ ID NO: 16 - protein, 14 aa, Homo sapiens
ASSTGAVTSGYYPN

SEQ ID NO: 17 - protein, 7 aa, Homo sapiens
STSKKHS

SEQ ID NO: 18 - protein, 9 aa, Homo sapiens
LLSYGGARV

SEQ ID NO: 19 - protein, 5 aa, Homo sapiens
SYGIS

SEQ ID NO: 20 - protein, 17 aa, Homo sapiens
RIIPVGGNTLYSQMFQG

SEQ ID NO: 21 - protein, 9 aa, Homo sapiens
DGGRWQFDY

SEQ ID NO: 22 - protein, 11 aa, Homo sapiens
RASQGISNWLA

SEQ ID NO: 23 - protein, 7 aa, Homo sapiens
AASSLQS

SEQ ID NO: 24 - protein, 9 aa, Homo sapiens
QQSKNFPYT

SEQ ID NO: 25 - protein, 5 aa, Homo sapiens
SYWIG

SEQ ID NO: 26 - protein, 17 aa, Homo sapiens
IIYPGDSDTRYSPSFQG

SEQ ID NO: 27 - protein, 14 aa, Homo sapiens
RYCSGGTCSDGFDI

SEQ ID NO: 28 - protein, 14 aa, Homo sapiens
TGTSSDVGGYNYVS

SEQ ID NO: 29 - protein, 7 aa, Homo sapiens
EVSKRPS

SEQ ID NO: 30 - protein, 10 aa, Homo sapiens
SSYAGSNNLV

SEQ ID NO: 31 - protein, 5 aa, Homo sapiens
SYWIG

SEQ ID NO: 32 - protein, 17 aa, Homo sapiens
IIYPGDSDTRYSPSFQG

SEQ ID NO: 33 - protein, 11 aa, Homo sapiens
LFRVRGGHFDS

SEQ ID NO: 34 - protein, 14 aa, Homo sapiens
TGTNSDVGGYNYVS

SEQ ID NO: 35 - protein, 7 aa, Homo sapiens
DVTNRPS

SEQ ID NO: 36 - protein, 10 aa, Homo sapiens
SSFTSSSTRV

SEQ ID NO: 37 - protein, 5 aa, Homo sapiens
SYGMH

SEQ ID NO: 38 - protein, 17 aa, Homo sapiens
MIWSDGSNKYYADSVKG

SEQ ID NO: 39 - protein, 13 aa, Homo sapiens
NYGSGSYWGGFDY

SEQ ID NO: 40 - protein, 14 aa, Homo sapiens
TGTSSDVGGYNLVS

SEQ ID NO: 41 - protein, 7 aa, Homo sapiens
EGSKRPS

SEQ ID NO: 42 - protein, 10 aa, Homo sapiens
SSYTTSSTHV

SEQ ID NO: 43 - protein, 5 aa, Homo sapiens
SYAIS

SEQ ID NO: 44 - protein, 17 aa, Homo sapiens
GIIPIFGTANYAQKFQG

SEQ ID NO: 45 - protein, 10 aa, Homo sapiens
LSPRYYGMDV

SEQ ID NO: 46 - protein, 14 aa, Homo sapiens
TGTSSDVGGYNYVS

SEQ ID NO: 47 - protein, 7 aa, Homo sapiens
GGSERPS

SEQ ID NO: 48 - protein, 10 aa, Homo sapiens
SSYTSSGTLL

SEQ ID NO: 49 - protein, 5 aa, Homo sapiens
SYAMY

SEQ ID NO: 50 - protein, 17 aa, Homo sapiens
LISHDASKMFYADSVKG

SEQ ID NO: 51 - protein, 9 aa, Homo sapiens
ERTGYYGAY

SEQ ID NO: 52 - protein, 11 aa, Homo sapiens
RASQGIGTWLA

SEQ ID NO: 53 - protein, 7 aa, Homo sapiens
SASSLQS

SEQ ID NO: 54 - protein, 9 aa, Homo sapiens
QQANSFPIT

SEQ ID NO: 55 - protein, 5 aa, Homo sapiens
SYAMS

SEQ ID NO: 56 - protein, 14 aa, Homo sapiens
ALSGSTTFYADSVK

SEQ ID NO: 57 - protein, 8 aa, Homo sapiens
GNYYGMDV

SEQ ID NO: 58 - protein, 13 aa, Homo sapiens
SGSSSNIGKFYVY

SEQ ID NO: 59 - protein, 7 aa, Homo sapiens
SNNQRPS

SEQ ID NO: 60 - protein, 11 aa, Homo sapiens
AAWDGSLNGYV

SEQ ID NO: 61 - DNA, 747 bp, Artificial sequence
  SC05-159
  CDS (1)..(747)
caggtccagctggtacagtctggggctgaggtgaagaagcccggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgacgacacggccgtgtattactgcgcgagagctgaggtgatgactacaattaacaactggtacttcgacctctggggccgtggcaccctggtcaccgtctcgagcggtacgggcggttcaggcggaaccggcagcggcactggcgggtcgacgtcctatgtgctgactcagccaccctcagcgtctgggacccccgggcagagggtcaccatctcttgttctggaagcagctccaacatcggaagtaataatgtaagctggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttgggtgttcggcggagggaccaagctgaccgtccta

SEQ ID NO: 62 - protein, 249 aa, Artificial sequence
  SC05-159
QVQLVQSGAEVKKPGATVKISCKVSGYTFTDYYMHWVQQAPGKGLEWMGLVDPEDGETIYAEKFQGRVTITADTSTDTAYMELSSLRSDDTAVYYCARAEVMTTINNWYFDLWGRGTLVTVSSGTGGSGGTGSGTGGSTSYVLTQPPSASGTPGQRVTISCSGSSSNIGSNNVSWYQQLPGTAPKLLIYSNNQRPSGVPDRFSGSKSGTSASLAISGLQSEDEADYYCAAWDDSLNGWVFGGGTKLTVL

SEQ ID NO: 63 - DNA, 777 bp, Artificial sequence
  SC05-166
  CDS (1)..(777)
caggtccagctggtacagtctggagctgaggtgaagaagcctggggcctcagtgaaggtctcctgcaaggcttctggttacacctttaccagctatgctatcagctgggtgcgacaggcccctggacaagggcttgagtggatgggatggatcagcgcttacaatggtaacacaaactatgcacggaagctccagggcagagtcaccatgaccacagacacatccacgagcacagcctacatggagctgaggagcctgagatctgacgacacggccgtgtattactgtgcgagagcggggctaatgtttacggcatggttcggggagttatgggaccacgggacgaaggacaactggttcgacccctggggccagggaaccctggtcaccgtctcgagcggtacgggcggttcaggcggaaccggcagcggcactggcgggtcgacgaattttatgctgactcagccccactctgtgtcggagtctccggggaagacggtaaccatctcctgcacccgcagcagtggcagcattgccagctactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcaggtgttcggcggagggaccaagctgaccgtccta

SEQ ID NO: 64 - protein, 259 aa, Artificial sequence
  SC05-166
QVQLVQSGAEVKKPGASVKVSCKASGYTFTSYAISWVRQAPGQGLEWMGWISAYNGNTNYARKLQGRVTMTTDTSTSTAYMELRSLRSDDTAVYYCARAGLMFTAWFGELWDHGTKDNWFDPWGQGTLVTVSSGTGGSGGTGSGTGGSTNFMLTQPHSVSESPGKTVTISCTRSSGSIASYYVQWYQQRPGSSPTTVIYEDNQRPSGVPDRFSGSIDSSSNSASLTISGLKTEDEADYYCQSYDSSNQVFGGGTKLTVL

SEQ ID NO: 65 - DNA, 738 bp, Artificial sequence
  SC05-187
  CDS (1)..(738)
gaggtccagctggtgcagtctggagcagaggtgaaaaagccgggggagtctctgaagatctcctgtaagggttctggatacagctttaccaagtactggatcggctgggtgcgccagatgcccgggaaaggcctggagtggatggggatcatctatcctggtgactctgacaccagatacagcccgtccttccaaggccaggtcaccatctcagccgacaagtccatcagtacagcctacctgcagtggagcagcctgaaggcctcggacaccgccatgtattactgtgcgagagggtcaggtattgcgaccgggaactcgttcgactcctggggccagggaaccctggtcaccgtctcgagcggtacgggcggttcaggcggaaccggcagcggcactggcgggtcgacgcagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaagaaacactcctggacccctgcccggttctcaggctccctccttgggggcagagctgccctgaccctttcgggtgcgcagcctgaggatgaggctgactattactgcttgctctcctatggtggtgctcgggtgttcggcggggggaccaagctgaccgtccta

SEQ ID NO: 66 - protein, 246 aa, Artificial sequence
  SC05-187
EVQLVQSGAEVKKPGESLKISCKGSGYSFTKYWIGWVRQMPGKGLEWMGIIYPGDSDTRYSPSFQGQVTISADKSISTAYLQWSSLKASDTAMYYCARGSGIATGNSFDSWGQGTLVTVSSGTGGSGGTGSGTGGSTQTVVTQEPSLTVSPGGTVTLTCASSTGAVTSGYYPNWFQQKPGQAPRALIYSTSKKHSWTPARFSGSLLGGRAALTLSGAQPEDEADYYCLLSYGGARVFGGGTKLTVL

SEQ ID NO: 67 - DNA, 723 bp, Artificial sequence
  SC06-016
  CDS (1)..(723)
caggtgcagctggtgcaatctggacctgaggtgaagaagcctggggcctcagtgacggtctcctgcaaggcttctggttacagctttagcagttatggtatcagctgggtgcgacaggcccctggacaagggcttgagtggatgggaagaatcatcccagttggaggtaacacactctactcacagatgttccagggcagagtcaccatgaccagtgacacgtccacgagcacagtctacctggagctgagcagcctgagatctgaggacaccgccgtctatttctgtgcgagagatggcggcaggtggcagtttgactactggggccagggaaccctggtcaccgtctcgagcggtacgggcggttcaggcggaaccggcagcggcactggcgggtcgacggacatccagttgacccagtctccatcttccgtgtctgcatctgtaggagacagagtcaccatcacttgtcgggcgagtcagggtattagcaactggttagcctggtatcagcagaaaccagggaaagcccctgaactcctgatttatgctgcatcaagtttacagagtggggtcccaccacggttcagcggcagtgcgtccgggacagatttcactctcaccatcagcagcctgcagcctgaagattttgcaacttattattgtcaacagtctaagaatttcccttacacttttggccaggggaccaaggtggagatcaaa

SEQ ID NO: 68 - protein, 241 aa, Artificial sequence
  SC06-016
QVQLVQSGPEVKKPGASVTVSCKASGYSFSSYGISWVRQAPGQGLEWMGRIIPVGGNTLYSQMFQGRVTMTSDTSTSTVYLELSSLRSEDTAVYFCARDGGRWQFDYWGQGTLVTVSSGTGGSGGTGSGTGGSTDIQLTQSPSSVSASVGDRVTITCRASQGISNWLAWYQQKPGKAPELLIYAASSLQSGVPPRFSGSASGTDFTLTISSLQPEDFATYYCQQSKNFPYTFGQGTKVEIK

SEQ ID NO: 69 - DNA, 747 bp, Artificial sequence
  SC06-043
  CDS (1)..(747)
gaggtgcagctggtggagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgatattgtagtggtggtacctgctccgatggttttgatatctggggccaagggacaatggtcaccgtctcgagcggtacgggcggttcaggcggaaccggcagcggcactggcgggtcgacgcagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttggtattcggcggagggaccaagctgaccgtccta

SEQ ID NO: 70 - protein, 249 aa, Artificial sequence
  SC06-043
EVQLVESGAEVKKPGESLKISCKGSGYSFTSYWIGWVRQMPGKGLEWMGIIYPGDSDTRYSPSFQGQVTISADKSISTAYLQWSSLKASDTAMYYCARRYCSGGTCSDGFDIWGQGTMVTVSSGTGGSGGTGSGTGGSTQSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNLVFGGGTKLTVL

SEQ ID NO: 71 - DNA, 738 bp, Artificial sequence
  SC06-049
  CDS (1)..(738)
caggtccagctggtgcagtctggagcagaggtgaaaaagcccggggagtctctgaagatctcctgtaagggttctggatacagctttaccagctactggattggctgggtgcgccagatgcccgggaaaggcctggagtggatggggatcatctatcctggtgactctgataccagatacagcccgtccttccaaggccaggtcaccatctcagccgacaagtccatcggcaccgcctacctgcagtggagcagcctgaaggcctcggacaccgccatgtattactgtgcgagactttttcgggttcggggaggccactttgactcctggggccagggaaccctggtcaccgtctcgagcggtacgggcggttcaggcggaaccggcagcggcactggcgggtcgacgcagtctgccctgactcagcctgcctccgtgtctgggtctcctggacagtcgatcaccatctcctgcactggaaccaacagtgacgttggtggttataactatgtctcctggtaccaacaacacccaggcaaggcccccaaactcctgatttatgatgtcactaatcggccctcgggggtttctaatcgcttctctgcctccaagtctggcaacacggcctccctgaccatctctgggctccaggctgaggacgaggctgattattactgcagctcatttacaagcagcagcactcgggtgttcggcggagggaccaagctgaccgtccta

SEQ ID NO: 72 - protein, 246 aa, Artificial sequence
  SC06-049
QVQLVQSGAEVKKPGESLKISCKGSGYSFTSYWIGWVRQMPGKGLEWMGIIYPGDSDTRYSPSFQGQVTISADKSIGTAYLQWSSLKASDTAMYYCARLFRVRGGHFDSWGQGTLVTVSSGTGGSGGTGSGTGGSTQSALTQPASVSGSPGQSITISCTGTNSDVGGYNYVSWYQQHPGKAPKLLIYDVTNRPSGVSNRFSASKSGNTASLTISGLQAEDEADYYCSSFTSSSTRVFGGGTKLTVL

SEQ ID NO: 73 - DNA, 744 bp, Artificial sequence
  SC06-071
  CDS (1)..(744)
gaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcgatgatctggtctgatggaagtaataaatactatgcagactccgtgaagggccgattcaccatctccagagacaattccaagaacacgctgtatctgcaaatgaacagcctgagagtcgaggacacggctgtgtattactgtgcgagcaactatggttcggggagttattgggggggatttgactactggggccagggaaccctggtcaccgtctcgagcggtacgggcggttcaggcggaaccggcagcggcactggcgggtcgacgcagtctgccctgactcagcctgcctccgtgtctgggtctcctggacagtcgatcaccatctcctgcactggaaccagcagtgacgttggtggttataaccttgtctcctggtaccaacagcacccaggcaaagcccccaaactcatgatttatgagggcagtaagcggccctcaggggtttctaatcgcttctttggctccaagtctggcgacacggcttccctgaccatctctgggctccaggctgaggacgaggctgattattactgcagctcatatacaaccagcagcactcatgtcttcggaactgggaccaaggtcaccgtccta

SEQ ID NO: 74 - protein, 248 aa, Artificial sequence
  SC06-071
EVQLVESGGGVVQPGRSLRLSCAASGFTFSSYGMHWVRQAPGKGLEWVAMIWSDGSNKYYADSVKGRFTISRDNSKNTLYLQMNSLRVEDTAVYYCASNYGSGSYWGGFDYWGQGTLVTVSSGTGGSGGTGSGTGGSTQSALTQPASVSGSPGQSITISCTGTSSDVGGYNLVSWYQQHPGKAPKLMIYEGSKRPSGVSNRFFGSKSGDTASLTISGLQAEDEADYYCSSYTTSSTHVFGTGTKVTVL

SEQ ID NO: 75 - DNA, 735 bp, Artificial sequence
  SC06-078
  CDS (1)..(735)
gaggtgcagctggtggagtctggggctgaggtgaagaagcctgggtcctcggtgaaggtctcctgcaaggcttctggaggcaccttcagcagctatgctattagctgggtgcgacaggcccctggacaagggcttgagtggatgggagggatcatccctatctttggtacagcaaactacgcacagaagttccagggcaaagtcacgattaccgcggacgaatccacgagcacagcctacatggagctgagcagcctgagatctgaggacacggccgtgtattactgtgcgagactcagcccgcgctactacggtatggacgtctggggccaagggaccacggtcaccgtctcgagcggtacgggcggttcaggcggaaccggcagcggcactggcgggtcgacgcagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgggggcagtgagcggccctcaggggtttctaatcgcttctctggctccaagtctggcaacacggcctccctgacaatctctggggtccaggctgaggacgaggctgattattactgcagctcatatacaagcagcggcactctgctattcggcggaggcacccagctgaccgtcctc

SEQ ID NO: 76 - protein, 245 aa, Artificial sequence
  SC06-078
EVQLVESGAEVKKPGSSVKVSCKASGGTFSSYAISWVRQAPGQGLEWMGGIIPIFGTANYAQKFQGKVTITADESTSTAYMELSSLRSEDTAVYYCARLSPRYYGMDVWGQGTTVTVSSGTGGSGGTGSGTGGSTQSALTQPRSVSGSPGQSVTISCTGTSSDVGGYNYVSWYQQHPGKAPKLMIYGGSERPSGVSNRFSGSKSGNTASLTISGVQAEDEADYYCSSYTSSGTLLFGGGTQLTVL

SEQ ID NO: 77 - DNA, 723 bp, Artificial sequence
  SC06-241
  CDS (1)..(723)
gaggtgcagctggtggagtctgggggaggcttggtccagcctgggaggtccctgagactctcctgtgcagcctctggattcaccttcagaagctatgctatgtactgggtccgccaggctccaggcaaggggctagagtggctggcacttatatcacacgatgcaagtaaaatgttctacgcagactccgtgaagggccgattcaccatctccagagacaattccaagaacaccttgtctctacaaatgaacagcctgacaattgaggacacggctgtgtattattgtgtgagagagcggactggttattacggggcttactggggccagggaaccctggtcaccgtctcgagcggtacgggcggttcaggcggaaccggcagcggcactggcgggtcgacggacatccagatgacccagtctccatcttccctgtctgcatctgtaggagacagagtcaccctcacttgtcgggcgagtcagggtattggcacctggttagcctggtatcagcagaaaccagggaaagcccctaagctcctgatctattctgcatccagtttgcaaagtggggtcccatcaaggttcagtggcagtggatctgggacagatttcactctcagcatcagcaacctgcagcctgaagattttgcaacttactattgtcaacaggctaacagtttcccgatcaccttcggccaagggacacgactggagattaaa

SEQ ID NO: 78 - protein, 241 aa, Artificial sequence
  SC06-241
EVQLVESGGGLVQPGRSLRLSCAASGFTFRSYAMYWVRQAPGKGLEWLALISHDASKMFYADSVKGRFTISRDNSKNTLSLQMNSLTIEDTAVYYCVRERTGYYGAYWGQGTLVTVSSGTGGSGGTGSGTGGSTDIQMTQSPSSLSASVGDRVTLTCRASQGIGTWLAWYQQKPGKAPKLLIYSASSLQSGVPSRFSGSGSGTDFTLSISNLQPEDFATYYCQQANSFPITFGQGTRLEIK

SEQ ID NO: 79 - DNA, 723 bp, Artificial sequence
  SC06-252
  CDS (1)..(723)
gaggtgcagctggtggagaccgggggaggcctcgtacagcctggggggtccctgagactctcctgtgcagcctctggactcacctttagcagctatgccatgagctgggtccgccaggctccagggaaggggctggagtgggtctcagctcttagtggtagtaccacattctacgcagactccgtgaagggccggttcaccatctccagagacaacgccaagaacacgctgtatctgcaaatgaacagtctgagagccgaggacacggctgtgtattactgtgcacgaggtaattactacggtatggacgtctggggccaagggaccacggtcaccgtctcgagcggtacgggcggttcaggcggaaccggcagcggcactggcgggtcgacgtcctatgtgctgactcagccaccctcagcgtctgggacccccgggcagagggtcaccatctcttgttccggaagcagctccaacatcggaaagttttatgtgtactggtaccagcagttcccaggagcggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatggcagcctgaatggttatgtcttcggaactgggaccaaggtcaccgtccta

SEQ ID NO: 80 - protein, 241 aa, Artificial sequence
  SC06-252
EVQLVETGGGLVQPGGSLRLSCAASGLTFSSYAMSWVRQAPGKGLEWVSALSGSTTFYADSVKGRFTISRDNAKNTLYLQMNSLRAEDTAVYYCARGNYYGMDVWGQGTTVTVSSGTGGSGGTGSGTGGSTSYVLTQPPSASGTPGQRVTISCSGSSSNIGKFYVYWYQQFPGAAPKLLIYSNNQRPSGVPDRFSGSKSGTSASLAISGLQSEDEADYYCAAWDGSLNGYVFGTGTKVTVL

SEQ ID NO: 81 - DNA, 1359 bp, Homo sapiens
  CDS (1)..(1359)
caggtccagctggtacagtctggggctgaggtgaagaagcccggggctacagtgaaaatctcctgcaaggtttctggatacaccttcaccgactactacatgcactgggtgcaacaggcccctggaaaagggcttgagtggatgggacttgttgatcctgaagatggtgaaacaatatacgcagagaagttccagggcagagtcaccataaccgcggacacgtctacagacacagcctacatggagctgagcagcctgagatctgacgacacggccgtgtattactgcgcgagagctgaggtgatgactacaattaacaactggtacttcgacctctggggccgtggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 82 - protein, 453 aa, Homo sapiens
QVQLVQSGAEVKKPGATVKISCKVSGYTFTDYYMHWVQQAPGKGLEWMGLVDPEDGETIYAEKFQGRVTITADTSTDTAYMELSSLRSDDTAVYYCARAEVMTTINNWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 83 - DNA, 1389 bp, Homo sapiens
  CDS (1)..(1389)
caggtccagctggtacagtctggagctgaggtgaagaagcctggggcctcagtgaaggtctcctgcaaggcttctggttacacctttaccagctatgctatcagctgggtgcgacaggcccctggacaagggcttgagtggatgggatggatcagcgcttacaatggtaacacaaactatgcacggaagctccagggcagagtcaccatgaccacagacacatccacgagcacagcctacatggagctgaggagcctgagatctgacgacacggccgtgtattactgtgcgagagcggggctaatgtttacggcatggttcggggagttatgggaccacgggacgaaggacaactggttcgacccctggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 84 - protein, 463 aa, Homo sapiens
QVQLVQSGAEVKKPGASVKVSCKASGYTFTSYAISWVRQAPGQGLEWMGWISAYNGNTNYARKLQGRVTMTTDTSTSTAYMELRSLRSDDTAVYYCARAGLMFTAWFGELWDHGTKDNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 85 - DNA, 1353 bp, Homo sapiens
  CDS (1)..(1353)
gaggtccagctggtgcagtctggagcagaggtgaaaaagccgggggagtctctgaagatctcctgtaagggttctggatacagctttaccaagtactggatcggctgggtgcgccagatgcccgggaaaggcctggagtggatggggatcatctatcctggtgactctgacaccagatacagcccgtccttccaaggccaggtcaccatctcagccgacaagtccatcagtacagcctacctgcagtggagcagcctgaaggcctcggacaccgccatgtattactgtgcgagagggtcaggtattgcgaccgggaactcgttcgactcctggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 86 - protein, 451 aa, Homo sapiens
EVQLVQSGAEVKKPGESLKISCKGSGYSFTKYWIGWVRQMPGKGLEWMGIIYPGDSDTRYSPSFQGQVTISADKSISTAYLQWSSLKASDTAMYYCARGSGIATGNSFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 87 - DNA, 1344 bp, Homo sapiens
  CDS (1)..(1344)
caggtgcagctggtgcaatctggacctgaggtgaagaagcctggggcctcagtgacggtctcctgcaaggcttctggttacagctttagcagttatggtatcagctgggtgcgacaggcccctggacaagggcttgagtggatgggaagaatcatcccagttggaggtaacacactctactcacagatgttccagggcagagtcaccatgaccagtgacacgtccacgagcacagtctacctggagctgagcagcctgagatctgaggacaccgccgtctatttctgtgcgagagatggcggcaggtggcagtttgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 88 - protein, 448 aa, Homo sapiens
QVQLVQSGPEVKKPGASVTVSCKASGYSFSSYGISWVRQAPGQGLEWMGRIIPVGGNTLYSQMFQGRVTMTSDTSTSTVYLELSSLRSEDTAVYFCARDGGRWQFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 89 - DNA, 1359 bp, Homo sapiens
  CDS (1)..(1359)
gaggtgcagctggtggagtctggagcagaggtgaaaaagcccggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacgatattgtagtggtggtacctgctccgatggttttgatatctggggccaagggacaatggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 90 - protein, 453 aa, Homo sapiens
EVQLVESGAEVKKPGESLKISCKGSGYSFTSYWIGWVRQMPGKGLEWMGIIYPGDSDTRYSPSFQGQVTISADKSISTAYLQWSSLKASDTAMYYCARRYCSGGTCSDGFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 91 - DNA, 1350 bp, Homo sapiens
  CDS (1)..(1350)
caggtccagctggtgcagtctggagcagaggtgaaaaagcccggggagtctctgaagatctcctgtaagggttctggatacagctttaccagctactggattggctgggtgcgccagatgcccgggaaaggcctggagtggatggggatcatctatcctggtgactctgataccagatacagcccgtccttccaaggccaggtcaccatctcagccgacaagtccatcggcaccgcctacctgcagtggagcagcctgaaggcctcggacaccgccatgtattactgtgcgagactttttcgggttcggggaggccactttgactcctggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 92 - protein, 450 aa, Homo sapiens
QVQLVQSGAEVKKPGESLKISCKGSGYSFTSYWIGWVRQMPGKGLEWMGIIYPGDSDTRYSPSFQGQVTISADKSIGTAYLQWSSLKASDTAMYYCARLFRVRGGHFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 93 - DNA, 1356 bp, Homo sapiens
  CDS (1)..(1356)
gaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcgatgatctggtctgatggaagtaataaatactatgcagactccgtgaagggccgattcaccatctccagagacaattccaagaacacgctgtatctgcaaatgaacagcctgagagtcgaggacacggctgtgtattactgtgcgagcaactatggttcggggagttattgggggggatttgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 94 - protein, 452 aa, Homo sapiens
EVQLVESGGGVVQPGRSLRLSCAASGFTFSSYGMHWVRQAPGKGLEWVAMIWSDGSNKYYADSVKGRFTISRDNSKNTLYLQMNSLRVEDTAVYYCASNYGSGSYWGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 95 - DNA, 1347 bp, Homo sapiens
  CDS (1)..(1347)
gaggtgcagctggtggagtctggggctgaggtgaagaagcctgggtcctcggtgaaggtctcctgcaaggcttctggaggcaccttcagcagctatgctattagctgggtgcgacaggcccctggacaagggcttgagtggatgggagggatcatccctatctttggtacagcaaactacgcacagaagttccagggcaaagtcacgattaccgcggacgaatccacgagcacagcctacatggagctgagcagcctgagatctgaggacacggccgtgtattactgtgcgagactcagcccgcgctactacggtatggacgtctggggccaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 96 - protein, 449 aa, Homo sapiens
EVQLVESGAEVKKPGSSVKVSCKASGGTFSSYAISWVRQAPGQGLEWMGGIIPIFGTANYAQKFQGKVTITADESTSTAYMELSSLRSEDTAVYYCARLSPRYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 97 - DNA, 1344 bp, Homo sapiens
  CDS (1)..(1344)
gaggtgcagctggtggagtctgggggaggcttggtccagcctgggaggtccctgagactctcctgtgcagcctctggattcaccttcagaagctatgctatgtactgggtccgccaggctccaggcaaggggctagagtggctggcacttatatcacacgatgcaagtaaaatgttctacgcagactccgtgaagggccgattcaccatctccagagacaattccaagaacaccttgtctctacaaatgaacagcctgacaattgaggacacggctgtgtattattgtgtgagagagcggactggttattacggggcttactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 98 - protein, 448 aa, Homo sapiens
EVQLVESGGGLVQPGRSLRLSCAASGFTFRSYAMYWVRQAPGKGLEWLALISHDASKMFYADSVKGRFTISRDNSKNTLSLQMNSLTIEDTAVYYCVRERTGYYGAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 99 - DNA, 1335 bp, Homo sapiens
  CDS (1)..(1335)
gaggtgcagctggtggagaccgggggaggcctcgtacagcctggggggtccctgagactctcctgtgcagcctctggactcacctttagcagctatgccatgagctgggtccgccaggctccagggaaggggctggagtgggtctcagctcttagtggtagtaccacattctacgcagactccgtgaagggccggttcaccatctccagagacaacgccaagaacacgctgtatctgcaaatgaacagtctgagagccgaggacacggctgtgtattactgtgcacgaggtaattactacggtatggacgtctggggccaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 100 - protein, 445 aa, Homo sapiens
EVQLVETGGGLVQPGGSLRLSCAASGLTFSSYAMSWVRQAPGKGLEWVSALSGSTTFYADSVKGRFTISRDNAKNTLYLQMNSLRAEDTAVYYCARGNYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - DNA, 660 bp, Homo sapiens
  CDS (1)..(660)
tcctatgtgctgactcagccaccctcagcgtctgggacccccgggcagagggtcaccatctcttgttctggaagcagctccaacatcggaagtaataatgtaagctggtaccagcagctcccaggaacggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatgacagcctgaatggttgggtgttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 102 - protein, 220 aa, Homo sapiens
SYVLTQPPSASGTPGQRVTISCSGSSSNIGSNNVSWYQQLPGTAPKLLIYSNNQRPSGVPDRFSGSKSGTSASLAISGLQSEDEADYYCAAWDDSLNGWVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 103 - DNA, 660 bp, Homo sapiens
  CDS (1)..(660)
aattttatgctgactcagccccactctgtgtcggagtctccggggaagacggtaaccatctcctgcacccgcagcagtggcagcattgccagctactatgtgcagtggtaccagcagcgcccgggcagttcccccaccactgtgatctatgaggataaccaaagaccctctggggtccctgatcggttctctggctccatcgacagctcctccaactctgcctccctcaccatctctggactgaagactgaggacgaggctgactactactgtcagtcttatgatagcagcaatcaggtgttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 104 - protein, 220 aa, Homo sapiens
NFMLTQPHSVSESPGKTVTISCTRSSGSIASYYVQWYQQRPGSSPTTVIYEDNQRPSGVPDRFSGSIDSSSNSASLTISGLKTEDEADYYCQSYDSSNQVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 105 - DNA, 657 bp, Homo sapiens
  CDS (1)..(657)
cagactgtggtgactcaggagccctcactgactgtgtccccaggagggacagtcactctcacctgtgcttccagcactggagcagtcaccagtggttactatccaaactggttccagcagaaacctggacaagcacccagggcactgatttatagtacaagcaagaaacactcctggacccctgcccggttctcaggctccctccttgggggcagagctgccctgaccctttcgggtgcgcagcctgaggatgaggctgactattactgcttgctctcctatggtggtgctcgggtgttcggcggggggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 106 - protein, 219 aa, Homo sapiens
QTVVTQEPSLTVSPGGTVTLTCASSTGAVTSGYYPNWFQQKPGQAPRALIYSTSKKHSWTPARFSGSLLGGRAALTLSGAQPEDEADYYCLLSYGGARVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 107 - DNA, 639 bp, Homo sapiens
  CDS (1)..(639)
gacatccagttgacccagtctccatcttccgtgtctgcatctgtaggagacagagtcaccatcacttgtcgggcgagtcagggtattagcaactggttagcctggtatcagcagaaaccagggaaagcccctgaactcctgatttatgctgcatcaagtttacagagtggggtcccaccacggttcagcggcagtgcgtccgggacagatttcactctcaccatcagcagcctgcagcctgaagattttgcaacttattattgtcaacagtctaagaatttcccttacacttttggccaggggaccaaggtggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 108 - protein, 213 aa, Homo sapiens
DIQLTQSPSSVSASVGDRVTITCRASQGISNWLAWYQQKPGKAPELLIYAASSLQSGVPPRFSGSASGTDFTLTISSLQPEDFATYYCQQSKNFPYTFGQGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 109 - DNA, 660 bp, Homo sapiens
  CDS (1)..(660)
cagtctgccctgactcagcctccctccgcgtccgggtctcctggacagtcagtcaccatctcctgcactggaaccagcagtgacgttggtggttataactatgtctcctggtaccaacagcacccaggcaaagcccccaaactcatgatttatgaggtcagtaagcggccctcaggggtccctgatcgcttctctggctccaagtctggcaacacggcctccctgaccgtctctgggctccaggctgaggatgaggctgattattactgcagctcatatgcaggcagcaacaatttggtattcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 110 - protein, 220 aa, Homo sapiens
QSALTQPPSASGSPGQSVTISCTGTSSDVGGYNYVSWYQQHPGKAPKLMIYEVSKRPSGVPDRFSGSKSGNTASLTVSGLQAEDEADYYCSSYAGSNNLVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 111 - DNA, 660 bp, Homo sapiens
  CDS (1)..(660)
cagtctgccctgactcagcctgcctccgtgtctgggtctcctggacagtcgatcaccatctcctgcactggaaccaacagtgacgttggtggttataactatgtctcctggtaccaacaacacccaggcaaggcccccaaactcctgatttatgatgtcactaatcggccctcgggggtttctaatcgcttctctgcctccaagtctggcaacacggcctccctgaccatctctgggctccaggctgaggacgaggctgattattactgcagctcatttacaagcagcagcactcgggtgttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 112 - protein, 220 aa, Homo sapiens
QSALTQPASVSGSPGQSITISCTGTNSDVGGYNYVSWYQQHPGKAPKLLIYDVTNRPSGVSNRFSASKSGNTASLTISGLQAEDEADYYCSSFTSSSTRVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 113 - DNA, 660 bp, Homo sapiens
  CDS (1)..(660)
cagtctgccctgactcagcctgcctccgtgtctgggtctcctggacagtcgatcaccatctcctgcactggaaccagcagtgacgttggtggttataaccttgtctcctggtaccaacagcacccaggcaaagcccccaaactcatgatttatgagggcagtaagcggccctcaggggtttctaatcgcttctttggctccaagtctggcgacacggcttccctgaccatctctgggctccaggctgaggacgaggctgattattactgcagctcatatacaaccagcagcactcatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 114 - protein, 220 aa, Homo sapiens
QSALTQPASVSGSPGQSITISCTGTSSDVGGYNLVSWYQQHPGKAPKLMIYEGSKRPSGVSNRFFGSKSGDTASLTISGLQAEDEADYYCSSYTTSSTHVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 115 - DNA, 660 bp, Homo sapiens
  CDS (1)..(660)
cagtctgccctgactcagcctcgctcagtgtccgggtctcctggacagtcagtcaccatctcctgcactggaaccagcagtgatgttggtggttataactatgtctcctggtaccaacagcacccaggcaaagcccccaaactcatgatttatgggggcagtgagcggccctcaggggtttctaatcgcttctctggctccaagtctggcaacacggcctccctgacaatctctggggtccaggctgaggacgaggctgattattactgcagctcatatacaagcagcggcactctgctattcggcggaggcacccagctgaccgtcctcggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 116 - protein, 220 aa, Homo sapiens
QSALTQPRSVSGSPGQSVTISCTGTSSDVGGYNYVSWYQQHPGKAPKLMIYGGSERPSGVSNRFSGSKSGNTASLTISGVQAEDEADYYCSSYTSSGTLLFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 117 - DNA, 639 bp, Homo sapiens
  CDS (1)..(639)
gacatccagatgacccagtctccatcttccctgtctgcatctgtaggagacagagtcaccctcacttgtcgggcgagtcagggtattggcacctggttagcctggtatcagcagaaaccagggaaagcccctaagctcctgatctattctgcatccagtttgcaaagtggggtcccatcaaggttcagtggcagtggatctgggacagatttcactctcagcatcagcaacctgcagcctgaagattttgcaacttactattgtcaacaggctaacagtttcccgatcaccttcggccaagggacacgactggagattaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 118 - protein, 213 aa, Homo sapiens
DIQMTQSPSSLSASVGDRVTLTCRASQGIGTWLAWYQQKPGKAPKLLIYSASSLQSGVPSRFSGSGSGTDFTLSISNLQPEDFATYYCQQANSFPITFGQGTRLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 119 - DNA, 660 bp, Homo sapiens
  CDS (1)..(660)
tcctatgtgctgactcagccaccctcagcgtctgggacccccgggcagagggtcaccatctcttgttccggaagcagctccaacatcggaaagttttatgtgtactggtaccagcagttcccaggagcggcccccaaactcctcatctatagtaataatcagcggccctcaggggtccctgaccgattctctggctccaagtctggcacctcagcctccctggccatcagtgggctccagtctgaggatgaggctgattattactgtgcagcatgggatggcagcctgaatggttatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 120 - protein, 220 aa, Homo sapiens
SYVLTQPPSASGTPGQRVTISCSGSSSNIGKFYVYWYQQFPGAAPKLLIYSNNQRPSGVPDRFSGSKSGTSASLAISGLQSEDEADYYCAAWDGSLNGYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 121 - DNA, 24 bp, Artificial sequence
  Anti-sense primer HuCK-FOR
acactctcccctgttgaagctctt

SEQ ID NO: 122 - DNA, 23 bp, Artificial sequence
  Anti-sense primer HuCL2-FOR
tgaacattctgtaggggccactg

SEQ ID NO: 123 - DNA, 23 bp, Artificial sequence
  Anti-sense primer HuCL7-FOR
agagcattctgcaggggccactg

SEQ ID NO: 124 - DNA, 4941 bp, Artificial sequence
  Vector PDV-C06
aagcttgcatgcaaattctatttcaaggagacagtcataatgaaatacctattgcctacggcagccgctggattgttattactcgcggcccagccggccatggccgaggtgtttgactaatggggcgcgcctcagggaaccctggtcaccgtctcgagcggtacgggcggttcaggcggaaccggcagcggcactggcgggtcgacggaaattgtgctcacacagtctccagccaccctgtctttgtctccaggggaaagagccaccctctcctgcagggccagtcagagtgttagcagctacttagcctggtaccaacagaaacctggccaggctcccaggctcctcatctatgatgcatccaacagggccactggcatcccagccaggttcagtggcagtgggtctgggacagacttcactctcaccatcagcagcctagagcctgaagattttgcagtttattactgtcagcagcgtagcaactggcctccggctttcggcggagggaccaaggtggagatcaaacgtgcggccgcacatcatcatcaccatcacggggccgcatataccgatattgaaatgaaccgcctgggcaaaggggccgcatagactgttgaaagttgtttagcaaaacctcatacagaaaattcatttactaacgtctggaaagacgacaaaactttagatcgttacgctaactatgagggctgtctgtggaatgctacaggcgttgtggtttgtactggtgacgaaactcagtgttacggtacatgggttcctattgggcttgctatccctgaaaatgagggtggtggctctgagggtggcggttctgagggtggcggttctgagggtggcggtactaaacctcctgagtacggtgatacacctattccgggctatacttatatcaaccctctcgacggcacttatccgcctggtactgagcaaaaccccgctaatcctaatccttctcttgaggagtctcagcctcttaatactttcatgtttcagaataataggttccgaaataggcagggtgcattaactgtttatacgggcactgttactcaaggcactgaccccgttaaaacttattaccagtacactcctgtatcatcaaaagccatgtatgacgcttactggaacggtaaattcagagactgcgctttccattctggctttaatgaggatccattcgtttgtgaatatcaaggccaatcgtctgacctgcctcaacctcctgtcaatgctggcggcggctctggtggtggttctggtggcggctctgagggtggcggctctgagggtggcggttctgagggtggcggctctgagggtggcggttccggtggcggctccggttccggtgattttgattatgaaaaaatggcaaacgctaataagggggctatgaccgaaaatgccgatgaaaacgcgctacagtctgacgctaaaggcaaacttgattctgtcgctactgattacggtgctgctatcgatggtttcattggtgacgtttccggccttgctaatggtaatggtgctactggtgattttgctggctctaattcccaaatggctcaagtcggtgacggtgataattcacctttaatgaataatttccgtcaatatttaccttctttgcctcagtcggttgaatgtcgcccttatgtctttggcgctggtaaaccatatgaattttctattgattgtgacaaaataaacttattccgtggtgtctttgcgtttcttttatatgttgccacctttatgtatgtattttcgacgtttgctaacatactgcgtaataaggagtcttaataagaattcactggccgtcgttttacaacgtcgtgactgggaaaaccctggcgttacccaacttaatcgccttgcagcacatccccctttcgccagctggcgtaatagcgaagaggcccgcaccgatcgcccttcccaacagttgcgcagcctgaatggcgaatggcgcctgatgcggtattttctccttacgcatctgtgcggtatttcacaccgcatacgtcaaagcaaccatagtacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgatttgggtgatggttcacgtagtgggccatcgccctgatagacggtttttcgccctttgacgttggagtccacgttctttaatagtggactcttgttccaaactggaacaacactcaaccctatctcgggctattcttttgatttataagggattttgccgatttcggcctattggttaaaaaatgagctgatttaacaaaaatttaacgcgaattttaacaaaatattaacgtttacaattttatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaagagcgcccaatacgcaaaccgcctctccccgcgcgttggccgattcattaatgcagctggcacgacaggtttcccgactggaaagcgggcagtgagcgcaacgcaattaatgtgagttagctcactcattaggcaccccaggctttacactttatgcttccggctcgtatgttgtgtggaattgtgagcggataacaatttcacacaggaaacagctatgaccatgattacgcc

SEQ ID NO: 125 - DNA, 24 bp, Artificial sequence
  Anti-sense primer HuCIgG
gtccaccttggtgttgctgggctt

SEQ ID NO: 126 - DNA, 24 bp, Artificial sequence
  Anti-sense primer HuCIgM
tggaagaggcacgttcttttcttt

SEQ ID NO: 127 - DNA, 10515 bp, Artificial sequence
  Vector pIg-C911-HCgamma1
  misc_feature (1326)..(5076): Stuffer
tcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgcatgaagaatctgcttagggttaggcgttttgcgctgcttcgctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaagctggcctggatatcctgactctcttaggtagccttgcagaagttggtcgtgaggcactgggcaggtaagtatcaaggttacaagacaggtttaaggagatcaatagaaactgggcttgtcgagacagagaagactcttgcgtttctgataggcacctattggtcttactgacatccactttgcctttctctccacaggtgtccactcccagttcaattacagctcgccaccatgggatggagctgtatcatcctcttcttggtactgctgctggcccagccggccagtgaccttgaccggtgcaccacttttgatgatgttcaagctcctaattacactcaacatacttcatctatgaggggggtttactatcctgatgaaatttttagatcggacactctttatttaactcaggatttatttcttccattttattctaatgttacagggtttcatactattaatcatacgtttggcaaccctgtcataccttttaaggatggtatttattttgctgccacagagaaatcaaatgttgtccgtggttgggtttttggttctaccatgaacaacaagtcacagtcggtgattattattaacaattctactaatgttgttatacgagcatgtaactttgaattgtgtgacaaccctttctttgctgtttctaaacccatgggtacacagacacatactatgatattcgataatgcatttaattgcactttcgagtacatatctgatgccttttcgcttgatgtttcagaaaagtcaggtaattttaaacacttacgagagtttgtgtttaaaaataaagatgggtttctctatgtttataagggctatcaacctatagatgtagttcgtgatctaccttctggttttaacactttgaaacctatttttaagttgcctcttggtattaacattacaaattttagagccattcttacagccttttcacctgctcaagacatttggggcacgtcagctgcagcctattttgttggctatttaaagccaactacatttatgctcaagtatgatgaaaatggtacaatcacagatgctgttgattgttctcaaaatccacttgctgaactcaaatgctctgttaagagctttgagattgacaaaggaatttaccagacctctaatttcagggttgttccctcaggagatgttgtgagattccctaatattacaaacttgtgtccttttggagaggtttttaatgctactaaattcccttctgtctatgcatgggagagaaaaaaaatttctaattgtgttgctgattactctgtgctctacaactcaacatttttttcaacctttaagtgctatggcgtttctgccactaagttgaatgatctttgcttctccaatgtctatgcagattcttttgtagtcaagggagatgatgtaagacaaatagcgccaggacaaactggtgttattgctgattataattataaattgccagatgatttcatgggttgtgtccttgcttggaatactaggaacattgatgctacttcaactggtaattataattataaatataggtatcttagacatggcaagcttaggccctttgagagagacatatctaatgtgcctttctcccctgatggcaaaccttgcaccccacctgctcttaattgttattggccattaaatgattatggtttttacaccactactggcattggctaccaaccttacagagttgtagtactttcttttgaacttttaaatgcaccggccacggtttgtggaccaaaattatccactgaccttattaagaaccagtgtgtcaattttaattttaatggactcactggtactggtgtgttaactccttcttcaaagagatttcaaccatttcaacaatttggccgtgatgtttctgatttcactgattccgttcgagatcctaaaacatctgaaatattagacatttcaccttgctcttttgggggtgtaagtgtaattacacctggaacaaatgcttcatctgaagttgctgttctatatcaagatgttaactgcactgatgtttctacagcaattcatgcagatcaactcacaccagcttggcgcatatattctactggaaacaatgtattccagactcaggcaggctgtcttataggagctgagcatgtcgacacttcttatgagtgcgacattcctattggagctggcatttgtgctagttaccatacagtttctttattacgtagtactagccaaaaatctattgtggcttatactatgtctttaggtgctgatagttcaattgcttactctaataacaccattgctatacctactaacttttcaattagcattactacagaagtaatgcctgtttctatggctaaaacctccgtagattgtaatatgtacatctgcggagattctactgaatgtgctaatttgcttctccaatatggtagcttttgcacacaactaaatcgtgcactctcaggtattgctgctgaacaggatcgcaacacacgtgaagtgttcgctcaagtcaaacaaatgtacaaaaccccaactttgaaatattttggtggttttaatttttcacaaatattacctgaccctctaaagccaactaagaggtcttttattgaggacttgctctttaataaggtgacactcgctgatgctggcttcatgaagcaatatggcgaatgcctaggtgatattaatgctagagatctcatttgtgcgcagaagttcaatggacttacagtgttgccacctctgctcactgatgatatgattgctgcctacactgctgctctagttagtggtactgccactgctggatggacatttggtgctggcgctgctcttcaaataccttttgctatgcaaatggcatataggttcaatggcattggagttacccaaaatgttctctatgagaaccaaaaacaaatcgccaaccaatttaacaaggcgattagtcaaattcaagaatcacttacaacaacatcaactgcattgggcaagctgcaagacgttgttaaccagaatgctcaagcattaaacacacttgttaaacaacttagctctaattttggtgcaatttcaagtgtgctaaatgatatcctttcgcgacttgataaagtcgaggcggaggtacaaattgacaggttaattacaggcagacttcaaagccttcaaacctatgtaacacaacaactaatcagggctgctgaaatcagggcttctgctaatcttgctgctactaaaatgtctgagtgtgttcttggacaatcaaaaagagttgacttttgtggaaagggctaccaccttatgtccttcccacaagcagccccgcatggtgttgtcttcctacatgtcacgtatgtgccatcccaggagaggaacttcaccacagcgccagcaatttgtcatgaaggcaaagcatacttccctcgtgaaggtgtttttgtgtttaatggcacttcttggtttattacacagaggaacttcttttctccacaaataattactacagacaatacatttgtctcaggaaattgtgatgtcgttattggcatcattaacaacacagtttatgatcctctgcaacctgagcttgactcattcaaagaagagctggacaagtacttcaaaaatcatacatcaccagatgttgattttggcgacatttcaggcattaacgcttctgtcgtcaacattcaaaaagaaattgaccgcctcaatgaggtcgctaaaaatttaaatgaatcactcattgaccttcaagaactgggaaaatatgagcaatatattaaatggcctctcgacgaacaaaaactcatctcagaagaggatctgaatgctgtgggccaggacacgcaggaggtcatcgtggtgccacactccttgccctttaaggtggtggtgatctcagccatcctggccctggtggtgctcaccatcatctcccttatcatcctcatcatgctttggcagaagaagccacgttaggcggccgctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaagtgataatctagagggcccgtttaaacccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttgccgatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcaagagacaggatgaggatcgtttcgcatgattgaacaagatggattgcacgcaggttctccggccgcttgggtggagaggctattcggctatgactgggcacaacagacaatcggctgctctgatgccgccgtgttccggctgtcagcgcaggggcgcccggttctttttgtcaagaccgacctgtccggtgccctgaatgaactgcaggacgaggcagcgcggctatcgtggctggccacgacgggcgttccttgcgcagctgtgctcgacgttgtcactgaagcgggaagggactggctgctattgggcgaagtgccggggcaggatctcctgtcatctcaccttgctcctgccgagaaagtatccatcatggctgatgcaatgcggcggctgcatacgcttgatccggctacctgcccattcgaccaccaagcgaaacatcgcatcgagcgagcacgtactcggatggaagccggtcttgtcgatcaggatgatctggacgaagagcatcaggggctcgcgccagccgaactgttcgccaggctcaaggcgcgcatgcccgacggcgaggatctcgtcgtgacccatggcgatgcctgcttgccgaatatcatggtggaaaatggccgcttttctggattcatcgactgtggccggctgggtgtggcggaccgctatcaggacatagcgttggctacccgtgatattgctgaagagcttggcggcgaatgggctgaccgcttcctcgtgctttacggtatcgccgctcccgattcgcagcgcatcgccttctatcgccttcttgacgagttcttctgagcgggactctggggttcgaaatgaccgaccaagcgacgcccaacctgccatcacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacg

SEQ ID NO: 128 - DNA, 8777 bp, Artificial sequence
  Vector pIg-C909-Ckappa
  misc_feature (1328)..(3860): Stuffer
tcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgttaattaacatgaagaatctgcttagggttaggcgttttgcgctgcttcgctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaatcgatgactctcttaggtagccttgcagaagttggtcgtgaggcactgggcaggtaagtatcaaggttacaagacaggtttaaggagatcaatagaaactgggcttgtcgagacagagaagactcttgcgtttctgataggcacctattggtcttactgacatccactttgcctttctctccacaggtgtccactcccagttcaattacagctcgccaccatgcggctgcccgcccagctgctgggccttctcatgctgtgggtgcccgcctcgagatctatcgatgcatgccatggtaccaagcttgccaccatgagcagcagctcttggctgctgctgagcctggtggccgtgacagccgcccagagcaccatcgaggagcaggccaagaccttcctggacaagttcaaccacgaggccgaggacctgttctaccagagcagcctggccagctggaactacaacaccaacatcaccgaggagaacgtgcagaacatgaacaacgccggcgacaagtggagcgccttcctgaaggagcagagcacactggcccagatgtaccccctgcaggagatccagaacctgaccgtgaagctgcagctgcaggccctgcagcagaacggcagcagcgtgctgagcgaggacaagagcaagcggctgaacaccatcctgaacaccatgtccaccatctacagcaccggcaaagtgtgcaaccccgacaacccccaggagtgcctgctgctggagcccggcctgaacgagatcatggccaacagcctggactacaacgagcggctgtgggcctgggagagctggcggagcgaagtgggcaagcagctgcggcccctgtacgaggagtacgtggtgctgaagaacgagatggccagggccaaccactacgaggactacggcgactactggagaggcgactacgaagtgaacggcgtggacggctacgactacagcagaggccagctgatcgaggacgtggagcacaccttcgaggagatcaagcctctgtacgagcacctgcacgcctacgtgcgggccaagctgatgaacgcctaccccagctacatcagccccatcggctgcctgcccgcccacctgctgggcgacatgtggggccggttctggaccaacctgtacagcctgaccgtgcccttcggccagaagcccaacatcgacgtgaccgacgccatggtggaccaggcctgggacgcccagcggatcttcaaggaggccgagaagttcttcgtgagcgtgggcctgcccaacatgacccagggcttttgggagaacagcatgctgaccgaccccggcaatgtgcagaaggccgtgtgccaccccaccgcctgggacctgggcaagggcgacttccggatcctgatgtgcaccaaagtgaccatggacgacttcctgaccgcccaccacgagatgggccacatccagtacgacatggcctacgccgcccagcccttcctgctgcggaacggcgccaacgagggctttcacgaggccgtgggcgagatcatgagcctgagcgccgccacccccaagcacctgaagagcatcggcctgctgagccccgacttccaggaggacaacgagaccgagatcaacttcctgctgaagcaggccctgaccatcgtgggcaccctgcccttcacctacatgctggagaagtggcggtggatggtgtttaagggcgagatccccaaggaccagtggatgaagaagtggtgggagatgaagcgggagatcgtgggcgtggtggagcccgtgccccacgacgagacctactgcgaccccgccagcctgttccacgtgagcaacgactactccttcatccggtactacacccggaccctgtaccagttccagttccaggaggccctgtgccaggccgccaagcacgagggccccctgcacaagtgcgacatcagcaacagcaccgaggccggacagaaactgttcaacatgctgcggctgggcaagagcgagccctggaccctggccctggagaatgtggtgggcgccaagaacatgaatgtgcgccccctgctgaactacttcgagcccctgttcacctggctgaaggaccagaacaagaacagcttcgtgggctggagcaccgactggagcccctacgccgaccagagcatcaaagtgcggatcagcctgaagagcgccctgggcgacaaggcctacgagtggaacgacaacgagatgtacctgttccggagcagcgtggcctatgccatgcggcagtacttcctgaaagtgaagaaccagatgatcctgttcggcgaggaggacgtgagagtggccaacctgaagccccggatcagcttcaacttcttcgtgaccgcccccaagaacgtgagcgacatcatcccccggaccgaagtggagaaggccatccggatgagccggagccggatcaacgacgccttccggctgaacgacaactccctggagttcctgggcatccagcccaccctgggccctcccaaccagccccccgtgagcatctggctgatcgtgtttggcgtggtgatgggcgtgatcgtggtgggaatcgtgatcctgatcttcaccggcatccgggaccggaagaagaagaacaaggcccggagcggcgagaacccctacgccagcatcgatatcagcaagggcgagaacaaccccggcttccagaacaccgacgacgtgcagaccagcttctgataatctagaacgagctcgaattcgaagcttctgcagacgcgtcgacgtcatatggatccgatatcgccgtggcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgttaatagacttaagtttaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggccatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccacaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacg

SEQ ID NO: 129 - DNA, 8792 bp, Artificial sequence
  Vector pIg-C910-Clambda
  misc_feature (1330)..(3869)
tcgacggatcgggagatctcccgatcccctatggtgcactctcagtacaatctgctctgatgccgcatagttaagccagtatctgctccctgcttgtgtgttggaggtcgctgagtagtgcgcgagcaaaatttaagctacaacaaggcaaggcttgaccgacaattgttaattaacatgaagaatctgcttagggttaggcgttttgcgctgcttcgctaggtggtcaatattggccattagccatattattcattggttatatagcataaatcaatattggctattggccattgcatacgttgtatccatatcataatatgtacatttatattggctcatgtccaacattaccgccatgttgacattgattattgactagttattaatagtaatcaattacggggtcattagttcatagcccatatatggagttccgcgttacataacttacggtaaatggcccgcctggctgaccgcccaacgacccccgcccattgacgtcaataatgacgtatgttcccatagtaacgccaatagggactttccattgacgtcaatgggtggagtatttacggtaaactgcccacttggcagtacatcaagtgtatcatatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctcgtttagtgaaccgtcagatcgcctggagacgccatccacgctgttttgacctccatagaagacaccgggaccgatccagcctccgcggccgggaacggtgcattggaatcgatgactctcttaggtagccttgcagaagttggtcgtgaggcactgggcaggtaagtatcaaggttacaagacaggtttaaggagatcaatagaaactgggcttgtcgagacagagaagactcttgcgtttctgataggcacctattggtcttactgacatccactttgcctttctctccacaggtgtccactcccagttcaattacagctcgccaccatgcggttctccgctcagctgctgggccttctggtgctgtggattcccggcgtctcgagatctatcgatgcatgccatggtaccaagcttgccaccatgagcagcagctcttggctgctgctgagcctggtggccgtgacagccgcccagagcaccatcgaggagcaggccaagaccttcctggacaagttcaaccacgaggccgaggacctgttctaccagagcagcctggccagctggaactacaacaccaacatcaccgaggagaacgtgcagaacatgaacaacgccggcgacaagtggagcgccttcctgaaggagcagagcacactggcccagatgtaccccctgcaggagatccagaacctgaccgtgaagctgcagctgcaggccctgcagcagaacggcagcagcgtgctgagcgaggacaagagcaagcggctgaacaccatcctgaacaccatgtccaccatctacagcaccggcaaagtgtgcaaccccgacaacccccaggagtgcctgctgctggagcccggcctgaacgagatcatggccaacagcctggactacaacgagcggctgtgggcctgggagagctggcggagcgaagtgggcaagcagctgcggcccctgtacgaggagtacgtggtgctgaagaacgagatggccagggccaaccactacgaggactacggcgactactggagaggcgactacgaagtgaacggcgtggacggctacgactacagcagaggccagctgatcgaggacgtggagcacaccttcgaggagatcaagcctctgtacgagcacctgcacgcctacgtgcgggccaagctgatgaacgcctaccccagctacatcagccccatcggctgcctgcccgcccacctgctgggcgacatgtggggccggttctggaccaacctgtacagcctgaccgtgcccttcggccagaagcccaacatcgacgtgaccgacgccatggtggaccaggcctgggacgcccagcggatcttcaaggaggccgagaagttcttcgtgagcgtgggcctgcccaacatgacccagggcttttgggagaacagcatgctgaccgaccccggcaatgtgcagaaggccgtgtgccaccccaccgcctgggacctgggcaagggcgacttccggatcctgatgtgcaccaaagtgaccatggacgacttcctgaccgcccaccacgagatgggccacatccagtacgacatggcctacgccgcccagcccttcctgctgcggaacggcgccaacgagggctttcacgaggccgtgggcgagatcatgagcctgagcgccgccacccccaagcacctgaagagcatcggcctgctgagccccgacttccaggaggacaacgagaccgagatcaacttcctgctgaagcaggccctgaccatcgtgggcaccctgcccttcacctacatgctggagaagtggcggtggatggtgtttaagggcgagatccccaaggaccagtggatgaagaagtggtgggagatgaagcgggagatcgtgggcgtggtggagcccgtgccccacgacgagacctactgcgaccccgccagcctgttccacgtgagcaacgactactccttcatccggtactacacccggaccctgtaccagttccagttccaggaggccctgtgccaggccgccaagcacgagggccccctgcacaagtgcgacatcagcaacagcaccgaggccggacagaaactgttcaacatgctgcggctgggcaagagcgagccctggaccctggccctggagaatgtggtgggcgccaagaacatgaatgtgcgccccctgctgaactacttcgagcccctgttcacctggctgaaggaccagaacaagaacagcttcgtgggctggagcaccgactggagcccctacgccgaccagagcatcaaagtgcggatcagcctgaagagcgccctgggcgacaaggcctacgagtggaacgacaacgagatgtacctgttccggagcagcgtggcctatgccatgcggcagtacttcctgaaagtgaagaaccagatgatcctgttcggcgaggaggacgtgagagtggccaacctgaagccccggatcagcttcaacttcttcgtgaccgcccccaagaacgtgagcgacatcatcccccggaccgaagtggagaaggccatccggatgagccggagccggatcaacgacgccttccggctgaacgacaactccctggagttcctgggcatccagcccaccctgggccctcccaaccagccccccgtgagcatctggctgatcgtgtttggcgtggtgatgggcgtgatcgtggtgggaatcgtgatcctgatcttcaccggcatccgggaccggaagaagaagaacaaggcccggagcggcgagaacccctacgccagcatcgatatcagcaagggcgagaacaaccccggcttccagaacaccgacgacgtgcagaccagcttctgataatctagaacgagctcgaattcgaagcttctgcagacgcgtcgacgtcatatggatccgatatcgccgtggcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagctaatagacttaagtttaaaccgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccagctggggctctagggggtatccccacgcgccctgtagcggcgcattaagcgcggcgggtgtggtggttacgcgcagcgtgaccgctacacttgccagcgccctagcgcccgctcctttcgctttcttcccttcctttctcgccacgttcgccggctttccccgtcaagctctaaatcgggggctccctttagggttccgatttagtgctttacggcacctcgaccccaaaaaacttgattagggtgatggttcacgtagtgggccatcgccctgatagacggtttttcgccctttgacgttggagtccacgttctttaatagtggactcttgttccaaactggaacaacactcaaccctatctcggtctattcttttgatttataagggattttggccatttcggcctattggttaaaaaatgagctgatttaacaaaaatttaacgcgaattaattctgtggaatgtgtgtcagttagggtgtggaaagtccccaggctccccagcaggcagaagtatgcaaagcatgcatctcaattagtcagcaaccaggtgtggaaagtccccaggctccccagcaggcagaagtatgcaaagcatgcatctcaattagtcagcaaccatagtcccgcccctaactccgcccatcccgcccctaactccgcccagttccgcccattctccgccccatggctgactaattttttttatttatgcagaggccgaggccgcctctgcctctgagctattccagaagtagtgaggaggcttttttggaggcctaggcttttgcaaaaagctcccgggagcttgtatatccattttcggatctgatcagcacgtgatgaaaaagcctgaactcaccgcgacgtctgtcgagaagtttctgatcgaaaagttcgacagcgtctccgacctgatgcagctctcggagggcgaagaatctcgtgctttcagcttcgatgtaggagggcgtggatatgtcctgcgggtaaatagctgcgccgatggtttctacaaagatcgttatgtttatcggcactttgcatcggccgcgctcccgattccggaagtgcttgacattggggaattcagcgagagcctgacctattgcatctcccgccgtgcacagggtgtcacgttgcaagacctgcctgaaaccgaactgcccgctgttctgcagccggtcgcggaggccatggatgcgatcgctgcggccgatcttagccagacgagcgggttcggcccattcggaccgcaaggaatcggtcaatacactacatggcgtgatttcatatgcgcgattgctgatccccatgtgtatcactggcaaactgtgatggacgacaccgtcagtgcgtccgtcgcgcaggctctcgatgagctgatgctttgggccgaggactgccccgaagtccggcacctcgtgcacgcggatttcggctccaacaatgtcctgacggacaatggccgcataacagcggtcattgactggagcgaggcgatgttcggggattcccaatacgaggtcgccaacatcttcttctggaggccgtggttggcttgtatggagcagcagacgcgctacttcgagcggaggcatccggagcttgcaggatcgccgcggctccgggcgtatatgctccgcattggtcttgaccaactctatcagagcttggttgacggcaatttcgatgatgcagcttgggcgcagggtcgatgcgacgcaatcgtccgatccggagccgggactgtcgggcgtacacaaatcgcccgcagaagcgcggccgtctggaccgatggctgtgtagaagtactcgccgatagtggaaaccgacgccccagcactcgtccgagggcaaaggaatagcacgtgctacgagatttcgattccaccgccgccttctatgaaaggttgggcttcggaatcgttttccgggacgccggctggatgatcctccagcgcggggatctcatgctggagttcttcgcccaccccaacttgtttattgcagcttataatggttacaaataaagcaatagcatcacaaatttcacaaataaagcatttttttcactgcattctagttgtggtttgtccaaactcatcaatgtatcttatcatgtctgtataccgtcgacctctagctagagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaagaacagtatttggtatctgcgctctgctgaagccagttaccttcggaaaaagagttggtagctcttgatccggcaaacaaaccaccgctggtagcggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgacg

SEQ ID NO: 130 - DNA, 23 bp, Artificial sequence
  HuVL1A-Back
cagtctgtgctgactcagccacc

SEQ ID NO: 131 - DNA, 23 bp, Artificial sequence
  HuVL1B-Back
cagtctgtgytgacgcagccgcc

SEQ ID NO: 132 - DNA, 23 bp, Artificial sequence
  HuVL1C-Back
cagtctgtcgtgacgcagccgcc

SEQ ID NO: 133 - DNA, 20 bp, Artificial sequence
  HuVL2B-Back
cagtctgccctgactcagcc

SEQ ID NO: 134 - DNA, 23 bp, Artificial sequence
  HuVL3A-Back
tcctatgwgctgactcagccacc

SEQ ID NO: 135 - DNA, 23 bp, Artificial sequence
  HuVL3B-Back
tcttctgagctgactcaggaccc

SEQ ID NO: 136 - DNA, 20 bp, Artificial sequence
  HuVL4B-Back
cagcytgtgctgactcaatc

SEQ ID NO: 137 - DNA, 23 bp, Artificial sequence
  HuVL5-Back
caggctgtgctgactcagccgtc

SEQ ID NO: 138 - DNA, 23 bp, Artificial sequence
  HuVL6-Back
aattttatgctgactcagcccca

SEQ ID NO: 139 - DNA, 23 bp, Artificial sequence
  HuVL7/8-Back
cagrctgtggtgacycaggagcc

SEQ ID NO: 140 - DNA, 23 bp, Artificial sequence
  HuVL9-Back
cwgcctgtgctgactcagccmcc

SEQ ID NO: 141 - DNA, 18 bp, Artificial sequence
  HuVL10-Back
caggcagggctgactcag

SEQ ID NO: 142 - DNA, 23 bp, Artificial sequence
  HuVK1B-Back
gacatccagwtgacccagtctcc

SEQ ID NO: 143 - DNA, 23 bp, Artificial sequence
  HuVK2-Back
gatgttgtgatgactcagtctcc

SEQ ID NO: 144 - DNA, 23 bp, Artificial sequence
  HuVK2B2
gatattgtgatgacccagactcc

SEQ ID NO: 145 - DNA, 23 bp, Artificial sequence
  HuVK3B-Back
gaaattgtgwtgacrcagtctcc

SEQ ID NO: 146 - DNA, 23 bp, Artificial sequence
  HuVK5-Back
gaaacgacactcacgcagtctcc

SEQ ID NO: 147 - DNA, 23 bp, Artificial sequence
  HuVK6-Back
gaaattgtgctgactcagtctcc

SEQ ID NO: 148 - DNA, 41 bp, Artificial sequence
  HuVK1B-Back-SAL
tgagcacacaggtcgacggacatccagwtgacccagtctcc

SEQ ID NO: 149 - DNA, 41 bp, Artificial sequence
  HuVK2-Back-SAL
tgagcacacaggtcgacggatgttgtgatgactcagtctcc

SEQ ID NO: 150 - DNA, 41 bp, Artificial sequence
  HuVK2B2-SAL
tgagcacacaggtcgacggatattgtgatgacccagactcc

SEQ ID NO: 151 - DNA, 41 bp, Artificial sequence
  HuVK3B-Back-SAL
tgagcacacaggtcgacggaaattgtgwtgacrcagtctcc

SEQ ID NO: 152 - DNA, 41 bp, Artificial sequence
  HuVK5-Back-SAL
tgagcacacaggtcgacggaaacgacactcacgcagtctcc

SEQ ID NO: 153 - DNA, 41 bp, Artificial sequence
  HuVK6-Back-SAL
tgagcacacaggtcgacggaaattgtgctgactcagtctcc

SEQ ID NO: 154 - DNA, 48 bp, Artificial sequence
  HuJK1-FOR-NOT
gagtcattctcgacttgcggccgcacgtttgatttccaccttggtccc

SEQ ID NO: 155 - DNA, 48 bp, Artificial sequence
  HuJK2-FOR-NOT
gagtcattctcgacttgcggccgcacgtttgatctccagcttggtccc

SEQ ID NO: 156 - DNA, 48 bp, Artificial sequence
  HuJK3-FOR-NOT
gagtcattctcgacttgcggccgcacgtttgatatccactttggtccc

SEQ ID NO: 157 - DNA, 47 bp, Artificial sequence
  HuJK4-FOR-NOT
gagtcattctcgacttgcggccgacgtttgatctccaccttggtccc

SEQ ID NO: 158 - DNA, 48 bp, Artificial sequence
  HuJK5-FOR-NOT
gagtcattctcgacttgcggccgcacgtttaatctccagtcgtgtccc

SEQ ID NO: 159 - DNA, 41 bp, Artificial sequence
  HuVL1A-Back-SAL
tgagcacacaggtcgacgcagtctgtgctgactcagccacc

SEQ ID NO: 160 - DNA, 41 bp, Artificial sequence
  HuVL1B-Back-SAL
tgagcacacaggtcgacgcagtctgtgytgacgcagccgcc

SEQ ID NO: 161 - DNA, 41 bp, Artificial sequence
  HuVL1C-Back-SAL
tgagcacacaggtcgacgcagtctgtcgtgacgcagccgcc

SEQ ID NO: 162 - DNA, 38 bp, Artificial sequence
  HuVL2B-Back-SAL
tgagcacacaggtcgacgcagtctgccctgactcagcc

SEQ ID NO: 163 - DNA, 41 bp, Artificial sequence
  HuVL3A-Back-SAL
tgagcacacaggtcgacgtcctatgwgctgactcagccacc

SEQ ID NO: 164 - DNA, 41 bp, Artificial sequence
  HuVL3B-Back-SAL
tgagcacacaggtcgacgtcttctgagctgactcaggaccc

SEQ ID NO: 165 - DNA, 38 bp, Artificial sequence
  HuVL4B-Back-SAL
tgagcacacaggtcgacgcagcytgtgctgactcaatc

SEQ ID NO: 166 - DNA, 41 bp, Artificial sequence
  HuVL5-Back-SAL
tgagcacacaggtcgacgcaggctgtgctgactcagccgtc

SEQ ID NO: 167 - DNA, 41 bp, Artificial sequence
  HuVL6-Back-SAL
tgagcacacaggtcgacgaattttatgctgactcagcccca

SEQ ID NO: 168 - DNA, 41 bp, Artificial sequence
  HuVL7/8-Back-SAL
tgagcacacaggtcgacgcagrctgtggtgacycaggagcc

SEQ ID NO: 169 - DNA, 41 bp, Artificial sequence
  HuVL9-Back-SAL
tgagcacacaggtcgacgcwgcctgtgctgactcagccmcc

SEQ ID NO: 170 - DNA, 36 bp, Artificial sequence
  HuVL10-Back-SAL
tgagcacacaggtcgacgcaggcagggctgactcag

SEQ ID NO: 171 - DNA, 48 bp, Artificial sequence
  HuJL1-FOR-NOT
gagtcattctcgacttgcggccgcacctaggacggtgaccttggtccc

SEQ ID NO: 172 - DNA, 48 bp, Artificial sequence
  HuJL2/3-FOR-NOT
gagtcattctcgacttgcggccgcacctaggacggtcagcttggtccc

SEQ ID NO: 173 - DNA, 48 bp, Artificial sequence
  HuJL7-FOR-NOT
gagtcattctcgacttgcggccgcaccgaggacggtcagctgggtgcc

SEQ ID NO: 174 - DNA, 23 bp, Artificial sequence
  HuVH1B/7A-Back
cagrtgcagctggtgcartctgg

SEQ ID NO: 175 - DNA, 23 bp, Artificial sequence
  HuVH1C-Back
saggtccagctggtrcagtctgg

SEQ ID NO: 176 - DNA, 23 bp, Artificial sequence
  HuVH2B-Back
cagrtcaccttgaaggagtctgg

SEQ ID NO: 177 - DNA, 18 bp, Artificial sequence
  HuVH3A-Back
gaggtgcagctggtggag

SEQ ID NO: 178 - DNA, 23 bp, Artificial sequence
  HuVH3C-Back
gaggtgcagctggtggagwcygg

SEQ ID NO: 179 - DNA, 23 bp, Artificial sequence
  HuVH4B-Back
caggtgcagctacagcagtgggg

SEQ ID NO: 180 - DNA, 23 bp, Artificial sequence
  HuVH4C-Back
cagstgcagctgcaggagtcsgg

SEQ ID NO: 181 - DNA, 23 bp, Artificial sequence
  HuVH6A-Back
caggtacagctgcagcagtcagg

SEQ ID NO: 182 - DNA, 56 bp, Artificial sequence
  HuVH1B/7A-Back-Sfi
gtcctcgcaactgcggcccagccggccatggcccagrtgcagctggtgcartctgg

SEQ ID NO: 183 - DNA, 56 bp, Artificial sequence
  HuVH1C-Back-Sfi
gtcctcgcaactgcggcccagccggccatggccsaggtccagctggtrcagtctgg

SEQ ID NO: 184 - DNA, 56 bp, Artificial sequence
  HuVH2B-Back-Sfi
gtcctcgcaactgcggcccagccggccatggcccagrtcaccttgaaggagtctgg

SEQ ID NO: 185 - DNA, 51 bp, Artificial sequence
  HuVH3A-Back-Sfi
gtcctcgcaactgcggcccagccggccatggccgaggtgcagctggtggag

SEQ ID NO: 186 - DNA, 56 bp, Artificial sequence
  HuVH3C-Back-Sfi
gtcctcgcaactgcggcccagccggccatggccgaggtgcagctggtggagwcygg

SEQ ID NO: 187 - DNA, 56 bp, Artificial sequence
  HuVH4B-Back-Sfi
gtcctcgcaactgcggcccagccggccatggcccaggtgcagctacagcagtgggg

SEQ ID NO: 188 - DNA, 56 bp, Artificial sequence
  HuVH4C-Back-Sfi
gtcctcgcaactgcggcccagccggccatggcccagstgcagctgcaggagtcsgg

SEQ ID NO: 189 - DNA, 56 bp, Artificial sequence
  HuVH6A-Back-Sfi
gtcctcgcaactgcggcccagccggccatggcccaggtacagctgcagcagtcagg

SEQ ID NO: 190 - DNA, 36 bp, Artificial sequence
  HuJH1/2-FOR-XhoIB
gagtcattctcgactcgagacrgtgaccagggtgcc

SEQ ID NO: 191 - DNA, 36 bp, Artificial sequence
  HuJH3-FOR-Xho
gagtcattctcgactcgagacggtgaccattgtccc

SEQ ID NO: 192 - DNA, 36 bp, Artificial sequence
  HuJH4/5-FOR-Xho
gagtcattctcgactcgagacggtgaccagggttcc

SEQ ID NO: 193 - DNA, 36 bp, Artificial sequence
  HuJH6-FOR-Xho
gagtcattctcgactcgagacggtgaccgtggtccc

SEQ ID NO: 194 - protein, 5 aa, Homo sapiens
SNSMN

SEQ ID NO: 195 - protein, 17 aa, Homo sapiens
FISSSSTYIYYADSVKG

SEQ ID NO: 196 - protein, 13 aa, Homo sapiens
ESAAGISYDAFDI

SEQ ID NO: 197 - protein, 14 aa, Homo sapiens
TGTSSDVGGYKYVS

SEQ ID NO: 198 - protein, 7 aa, Homo sapiens
EVSNRPS

SEQ ID NO: 199 - protein, 11 aa, Homo sapiens
SSYTSSSTLGV

SEQ ID NO: 200 - protein, 5 aa, Homo sapiens
SYSMN

SEQ ID NO: 201 - protein, 17 aa, Homo sapiens
FISSSSSTIYYADSVKG

SEQ ID NO: 202 - protein, 14 aa, Homo sapiens
PVGTGISLFHAFDI

SEQ ID NO: 203 - protein, 11 aa, Homo sapiens
GGNNIGSKYVH

SEQ ID NO: 204 - protein, 7 aa, Homo sapiens
DDSDRPS

SEQ ID NO: 205 - protein, 11 aa, Homo sapiens
QVWDGSSDPVV

SEQ ID NO: 206 - DNA, 747 bp, Artificial sequence
  SC06-087
  CDS (1)..(747)
gaggtgcagctggtggagtctgggggaggcctggtcaagcctggggggtccctgagactctcctgtgcagcctctggattcactttcagtagtaatagcatgaactgggtccgccaggctccagggaaggggctggagtgggtctcattcattagtagtagtagtacttacatatattacgcagactcagtgaagggccgattcaccatctccagagacaacgccaagaactcactgtatctgcaaatgaacagcctgagagccgaggacacggctgtatattactgtgcgagggagtcagcagctggcatttcttatgatgcttttgatatctggggccaagggacaatggtcaccgtctcgagcggtacgggcggttcaggcggaaccggcagcggcactggcgggtcgacgcagtctgccctgactcagcctgcctccgtgtctgggtctccaggacagtcgatcaccatctcctgcactggaaccagcagtgacgttggtggttataagtatgtctcctggtatcaacagcacccaggcaaagcccccaaactcatgatttatgaggtcagtaatcggccctcgggggtttctaatcgcttctctggctccaagtctggcagcacggcctccctgaccatctctgggctccaggctgaggacgaggctgattattactgcagctcatatacaagcagtagtactctgggggtcttcggaactgggaccaaggtcaccgtccta

SEQ ID NO: 207 - protein, 249 aa, Artificial sequence
  SC06-087
EVQLVESGGGLVKPGGSLRLSCAASGFTFSSNSMNWVRQAPGKGLEWVSFISSSSTYIYYADSVKGRFTISRDNAKNSLYLQMNSLRAEDTAVYYCARESAAGISYDAFDIWGQGTMVTVSSGTGGSGGTGSGTGGSTQSALTQPASVSGSPGQSITISCTGTSSDVGGYKYVSWYQQHPGKAPKLMIYEVSNRPSGVSNRFSGSKSGSTASLTISGLQAEDEADYYCSSYTSSSTLGVFGTGTKVTVL

SEQ ID NO: 208 - DNA, 741 bp, Artificial sequence
  SC06-089
  CDS (1)..(741)
gaggtgcagctggtggagactgggggaggcttggtacagcctggggggtccctgagactctcctgtgcagcctctggattcaccttcagtagttatagcatgaattgggtccgtcaggctccagggaaggggctggagtgggtttcattcatcagtagtagtagtagtaccatatactacgcggactctgtgaagggccgattcaccatcgccagagacaatgccaagaactcactgtatctgcaaatgaacagcctgagagacgaggacacggctgtgtattactgtgcgaggcccgtagggactgggattagcttgtttcatgcttttgatatctggggccaagggacaatggtcaccgtctcgagcggtacgggcggttcaggcggaaccggcagcggcactggcgggtcgacgcagtctgtgttgacgcagccgccctcggtgtcagtggccccaggacagacggccaggattacctgtgggggaaacaacattggaagtaaatatgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggagatgaggccgacttttactgtcaggtgtgggatggtagtagtgaccctgtggtgttcggcggtgggaccaagctgaccgtccta

SEQ ID NO: 209 - protein, 247 aa, Artificial sequence
  SC06-089
EVQLVETGGGLVQPGGSLRLSCAASGFTFSSYSMNWVRQAPGKGLEWVSFISSSSSTIYYADSVKGRFTIARDNAKNSLYLQMNSLRDEDTAVYYCARPVGTGISLFHAFDIWGQGTMVTVSSGTGGSGGTGSGTGGSTQSVLTQPPSVSVAPGQTARITCGGNNIGSKYVHWYQQKPGQAPVLVVYDDSDRPSGIPERFSGSNSGNTATLTISRVEAGDEADFYCQVWDGSSDPVVFGGGTKLTVL

SEQ ID NO: 210 - DNA, 1356 bp, Homo sapiens
  CDS (1)..(1356)
gaggtgcagctggtggagtctgggggaggcctggtcaagcctggggggtccctgagactctcctgtgcagcctctggattcactttcagtagtaatagcatgaactgggtccgccaggctccagggaaggggctggagtgggtctcattcattagtagtagtagtacttacatatattacgcagactcagtgaagggccgattcaccatctccagagacaacgccaagaactcactgtatctgcaaatgaacagcctgagagccgaggacacggctgtatattactgtgcgagggagtcagcagctggcatttcttatgatgcttttgatatctggggccaagggacaatggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 211 - protein, 452 aa, Homo sapiens
EVQLVESGGGLVKPGGSLRLSCAASGFTFSSNSMNWVRQAPGKGLEWVSFISSSSTYIYYADSVKGRFTISRDNAKNSLYLQMNSLRAEDTAVYYCARESAAGISYDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 212 - DNA, 1359 bp, Homo sapiens
  CDS (1)..(1359)
gaggtgcagctggtggagactgggggaggcttggtacagcctggggggtccctgagactctcctgtgcagcctctggattcaccttcagtagttatagcatgaattgggtccgtcaggctccagggaaggggctggagtgggtttcattcatcagtagtagtagtagtaccatatactacgcggactctgtgaagggccgattcaccatcgccagagacaatgccaagaactcactgtatctgcaaatgaacagcctgagagacgaggacacggctgtgtattactgtgcgaggcccgtagggactgggattagcttgtttcatgcttttgatatctggggccaagggacaatggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 213 - protein, 453 aa, Homo sapiens
EVQLVETGGGLVQPGGSLRLSCAASGFTFSSYSMNWVRQAPGKGLEWVSFISSSSSTIYYADSVKGRFTIARDNAKNSLYLQMNSLRDEDTAVYYCARPVGTGISLFHAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 214 - DNA, 663 bp, Homo sapiens
  CDS (1)..(663)
cagtctgccctgactcagcctgcctccgtgtctgggtctccaggacagtcgatcaccatctcctgcactggaaccagcagtgacgttggtggttataagtatgtctcctggtatcaacagcacccaggcaaagcccccaaactcatgatttatgaggtcagtaatcggccctcgggggtttctaatcgcttctctggctccaagtctggcagcacggcctccctgaccatctctgggctccaggctgaggacgaggctgattattactgcagctcatatacaagcagtagtactctgggggtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 215 - protein, 221 aa, Homo sapiens
QSALTQPASVSGSPGQSITISCTGTSSDVGGYKYVSWYQQHPGKAPKLMIYEVSNRPSGVSNRFSGSKSGSTASLTISGLQAEDEADYYCSSYTSSSTLGVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 216 - DNA, 654 bp, Homo sapiens
  CDS (1)..(654)
cagtctgtgttgacgcagccgccctcggtgtcagtggccccaggacagacggccaggattacctgtgggggaaacaacattggaagtaaatatgtgcactggtaccagcagaagccaggccaggcccctgtgctggtcgtctatgatgatagcgaccggccctcagggatccctgagcgattctctggctccaactctgggaacacggccaccctgaccatcagcagggtcgaagccggagatgaggccgacttttactgtcaggtgtgggatggtagtagtgaccctgtggtgttcggcggtgggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 217 - protein, 218 aa, Homo sapiens
QSVLTQPPSVSVAPGQTARITCGGNNIGSKYVHWYQQKPGQAPVLVVYDDSDRPSGIPERFSGSNSGNTATLTISRVEAGDEADFYCQVWDGSSDPVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 218 - protein, 5 aa, Homo sapiens
DYGMH

SEQ ID NO: 219 - protein, 17 aa, Homo sapiens
FIWPHGVNRFYADSMEG

SEQ ID NO: 220 - protein, 12 aa, Homo sapiens
DQDYVPRKYFDL

SEQ ID NO: 221 - protein, 11 aa, Homo sapiens
GGNNIGSKSVH

SEQ ID NO: 222 - protein, 7 aa, Homo sapiens
QDRRRPS

SEQ ID NO: 223 - protein, 9 aa, Homo sapiens
QAWDSSTGV

SEQ ID NO: 224 - protein, 5 aa, Homo sapiens
NYWIG

SEQ ID NO: 225 - protein, 17 aa, Homo sapiens
IVYPGDSDTRYSPSFQG

SEQ ID NO: 226 - protein, 12 aa, Homo sapiens
RMAVAGSDAFDI

SEQ ID NO: 227 - protein, 13 aa, Homo sapiens
SGSTSNIGSHNVN

SEQ ID NO: 228 - protein, 7 aa, Homo sapiens
INNKRPS

SEQ ID NO: 229 - protein, 11 aa, Homo sapiens
AAWDDSLRRPV

SEQ ID NO: 230 - protein, 5 aa, Homo sapiens
DYSMS

SEQ ID NO: 231 - protein, 17 aa, Homo sapiens
NISGSGHSTKYAESMRG

SEQ ID NO: 232 - protein, 8 aa, Homo sapiens
GGGYRMDV

SEQ ID NO: 233 - protein, 14 aa, Homo sapiens
TGTSSDVGGYNYVS

SEQ ID NO: 234 - protein, 7 aa, Homo sapiens
DVSKRPS

SEQ ID NO: 235 - protein, 11 aa, Homo sapiens
SSYAGSNNFVV

SEQ ID NO: 236 - protein, 5 aa, Homo sapiens
NYGIT

SEQ ID NO: 237 - protein, 17 aa, Homo sapiens
WISAYNAKTEYGQRLQG

SEQ ID NO: 238 - protein, 17 aa, Homo sapiens
VLGYRGGWYDEGDAFDV

SEQ ID NO: 239 - protein, 11 aa, Homo sapiens
RASQGIRSHLA

SEQ ID NO: 240 - protein, 7 aa, Homo sapiens
AASTLQS

SEQ ID NO: 241 - protein, 9 aa, Homo sapiens
QQLNTYPIT

SEQ ID NO: 242 - protein, 5 aa, Homo sapiens
SYAIS

SEQ ID NO: 243 - protein, 17 aa, Homo sapiens
GIIPIFGTANYAQKFQG

SEQ ID NO: 244 - protein, 10 aa, Homo sapiens
EGGVGPAFDI

SEQ ID NO: 245 - protein, 17 aa, Homo sapiens
KSSQSVLHNSNNKNYLA

SEQ ID NO: 246 - protein, 7 aa, Homo sapiens
WASTRES

SEQ ID NO: 247 - protein, 9 aa, Homo sapiens
QQYYGSPYT

SEQ ID NO: 248 - protein, 5 aa, Homo sapiens
SYAMS

SEQ ID NO: 249 - protein, 17 aa, Homo sapiens
AISGTGGSAYYADSVKG

SEQ ID NO: 250 - protein, 7 aa, Homo sapiens
GHSSGTN

SEQ ID NO: 251 - protein, 13 aa, Homo sapiens
SGSSSNIGSNFVY

SEQ ID NO: 252 - protein, 7 aa, Homo sapiens
RNNQRPS

SEQ ID NO: 253 - protein, 11 aa, Homo sapiens
AAWDDSLSGVL

SEQ ID NO: 254 - protein, 5 aa, Homo sapiens
SYAIS

SEQ ID NO: 255 - protein, 17 aa, Homo sapiens
GIIPIFGTANYAQKFQG

SEQ ID NO: 256 - protein, 11 aa, Homo sapiens
GYAATDYGMDV

SEQ ID NO: 257 - protein, 11 aa, Homo sapiens
RASQSISSYLN

SEQ ID NO: 258 - protein, 7 aa, Homo sapiens
AASSLQS

SEQ ID NO: 259 - protein, 9 aa, Homo sapiens
QQSYSTPFT

SEQ ID NO: 260 - protein, 5 aa, Homo sapiens
DYAMS

SEQ ID NO: 261 - protein, 19 aa, Homo sapiens
FIRNKAYGGTAEYAASVKD

SEQ ID NO: 262 - protein, 10 aa, Homo sapiens
REYDTGWLDY

SEQ ID NO: 263 - protein, 14 aa, Homo sapiens
TGTSSDVGGYNYVS

SEQ ID NO: 264 - protein, 7 aa, Homo sapiens
DVTDRPS

SEQ ID NO: 265 - protein, 11 aa, Homo sapiens
SSYTSSSTSAV

SEQ ID NO: 266 - protein, 5 aa, Homo sapiens
NYGMH

SEQ ID NO: 267 - protein, 17 aa, Homo sapiens
VIWYDGSNEDYADSVKG

SEQ ID NO: 268 - protein, 11 aa, Homo sapiens
GQYSSTWFLDY

SEQ ID NO: 269 - protein, 11 aa, Homo sapiens
RASQSISSWLA

SEQ ID NO: 270 - protein, 7 aa, Homo sapiens
KASSLET

SEQ ID NO: 271 - protein, 9 aa, Homo sapiens
QQANSFPLT

SEQ ID NO: 272 - protein, 5 aa, Homo sapiens
SYGMH

SEQ ID NO: 273 - protein, 17 aa, Homo sapiens
VIWYDGSNKYYADSVKG

SEQ ID NO: 274 - protein, 7 aa, Homo sapiens
SYAIAAT

SEQ ID NO: 275 - protein, 13 aa, Homo sapiens
SGSSSNIGSNYVY

SEQ ID NO: 276 - protein, 7 aa, Homo sapiens
RNNQRPS

SEQ ID NO: 277 - protein, 11 aa, Homo sapiens
AAWDDSLSGWV

SEQ ID NO: 278 - protein, 6 aa, Homo sapiens
SGYYWG

SEQ ID NO: 279 - protein, 16 aa, Homo sapiens
SIYHTGSTYYNPSLKS

SEQ ID NO: 280 - protein, 7 aa, Homo sapiens
QSPAFDF

SEQ ID NO: 281 - protein, 14 aa, Homo sapiens
TGSSSNIGTGYDVH

SEQ ID NO: 282 - protein, 7 aa, Homo sapiens
GNNNRPS

SEQ ID NO: 283 - protein, 11 aa, Homo sapiens
ATWDDSLNGWV

SEQ ID NO: 284 - protein, 5 aa, Homo sapiens
SYYWS

SEQ ID NO: 285 - protein, 10 aa, Homo sapiens
SYYWSPSLNS

SEQ ID NO: 286 - protein, 7 aa, Homo sapiens
GGQTAGV

SEQ ID NO: 287 - protein, 11 aa, Homo sapiens
GGYNIGRKSVH

SEQ ID NO: 288 - protein, 7 aa, Homo sapiens
DNSDRPS

SEQ ID NO: 289 - protein, 9 aa, Homo sapiens
QAWDRGTAV

SEQ ID NO: 290 - protein, 5 aa, Homo sapiens
SDFMT

SEQ ID NO: 291 - protein, 16 aa, Homo sapiens
LIYSGGKTNYADSVKG

SEQ ID NO: 292 - protein, 13 aa, Homo sapiens
SVCSTISCSKLDD

SEQ ID NO: 293 - protein, 11 aa, Homo sapiens
GGNNIGRKSVH

SEQ ID NO: 294 - protein, 7 aa, Homo sapiens
DNSDRPS

SEQ ID NO: 295 - protein, 11 aa, Homo sapiens
HVWGSSRDHYV

SEQ ID NO: 296 - protein, 5 aa, Homo sapiens
SYWIA

SEQ ID NO: 297 - protein, 17 aa, Homo sapiens
VIYPGDSDARYSPSFQG

SEQ ID NO: 298 - protein, 10 aa, Homo sapiens
LRSKNTGLDY

SEQ ID NO: 299 - protein, 14 aa, Homo sapiens
TGTSSDVGGYNFVS

SEQ ID NO: 300 - protein, 7 aa, Homo sapiens
EVSNRPS

SEQ ID NO: 301 - protein, 10 aa, Homo sapiens
SSYAGNNNLA

SEQ ID NO: 302 - protein, 5 aa, Homo sapiens
TYWIG

SEQ ID NO: 303 - protein, 17 aa, Homo sapiens
IIYPGDSDTRYSPSFQG

SEQ ID NO: 304 - protein, 12 aa, Homo sapiens
PGPRGYNHGFDY

SEQ ID NO: 305 - protein, 11 aa, Homo sapiens
QGDSLRRYYAS

SEQ ID NO: 306 - protein, 7 aa, Homo sapiens
GKNNRPS

SEQ ID NO: 307 - protein, 11 aa, Homo sapiens
NSRDSSGNSVV

SEQ ID NO: 308 - protein, 5 aa, Homo sapiens
TYWIG

SEQ ID NO: 309 - protein, 17 aa, Homo sapiens
IIYPGDSDTRYNPSFQG

SEQ ID NO: 310 - protein, 12 aa, Homo sapiens
RSARGGNWYFDL

SEQ ID NO: 311 - protein, 12 aa, Homo sapiens
RASQSVSSSYLA

SEQ ID NO: 312 - protein, 7 aa, Homo sapiens
GASSRAT

SEQ ID NO: 313 - protein, 9 aa, Homo sapiens
QQYGRSPLT

SEQ ID NO: 314 - protein, 5 aa, Homo sapiens
SYWIG

SEQ ID NO: 315 - protein, 17 aa, Homo sapiens
IIYPGDSDTRYSPSFQG

SEQ ID NO: 316 - protein, 18 aa, Homo sapiens
WGGVCSSTSCPNRDAFDI

SEQ ID NO: 317 - protein, 14 aa, Homo sapiens
TGTSSDVGGYNYVS

SEQ ID NO: 318 - protein, 7 aa, Homo sapiens
DVSNRPS

SEQ ID NO: 319 - protein, 12 aa, Homo sapiens
SSYRSSGASPVV

SEQ ID NO: 320 - protein, 5 aa, Homo sapiens
NYWIG

SEQ ID NO: 321 - protein, 17 aa, Homo sapiens
IIYPGDSDTRYSPSFQG

SEQ ID NO: 322 - protein, 13 aa, Homo sapiens
HTQNKNGMNTFDI

SEQ ID NO: 323 - protein, 14 aa, Homo sapiens
TGTSSDIGGYNYVS

SEQ ID NO: 324 - protein, 7 aa, Homo sapiens
EVSNRPP

SEQ ID NO: 325 - protein, 11 aa, Homo sapiens
SSYSTTTTRVI

SEQ ID NO: 326 - protein, 5 aa, Homo sapiens
DYAMH

SEQ ID NO: 327 - protein, 17 aa, Homo sapiens
GISWNSGSIGYADSVKG

SEQ ID NO: 328 - protein, 6 aa, Homo sapiens
GQRFDF

SEQ ID NO: 329 - protein, 14 aa, Homo sapiens
TGTSSDVGGYNYVS

SEQ ID NO: 330 - protein, 7 aa, Homo sapiens
DVNNRPS

SEQ ID NO: 331 - protein, 10 aa, Homo sapiens
GSSVGSRLRI

SEQ ID NO: 332 - protein, 5 aa, Homo sapiens
SHWIG

SEQ ID NO: 333 - protein, 17 aa, Homo sapiens
IIYPGDSDTRYSPSFQG

SEQ ID NO: 334 - protein, 11 aa, Homo sapiens
LGSSRWSHFDY

SEQ ID NO: 335 - protein, 14 aa, Homo sapiens
TGTSTDVGGYNYVS

SEQ ID NO: 336 - protein, 7 aa, Homo sapiens
GVSKRPS

SEQ ID NO: 337 - protein, 10 aa, Homo sapiens
SSYAGSNNLV

SEQ ID NO: 338 - protein, 5 aa, Homo sapiens
SYWIG

SEQ ID NO: 339 - protein, 17 aa, Homo sapiens
SIYPGDSDTRYSPSFQG

SEQ ID NO: 340 - protein, 12 aa, Homo sapiens
QYRAGSTTRFDP

SEQ ID NO: 341 - protein, 16 aa, Homo sapiens
RSSQSLRHRNGNNYLD

SEQ ID NO: 342 - protein, 7 aa, Homo sapiens
LGSNRAS

SEQ ID NO: 343 - protein, 9 aa, Homo sapiens
MQALQTPLT

SEQ ID NO: 344 - protein, 7 aa, Homo sapiens
SGGYYWS

SEQ ID NO: 345 - protein, 16 aa, Homo sapiens
YIYYSGSTYYNPSLKS

SEQ ID NO: 346 - protein, 10 aa, Homo sapiens
ERILDRMNDY

SEQ ID NO: 347 - protein, 14 aa, Homo sapiens
TGSSSNIGAGYDVH

SEQ ID NO: 348 - protein, 7 aa, Homo sapiens
GNSNRPS

SEQ ID NO: 349 - protein, 10 aa, Homo sapiens
QSSDSSLNIL

SEQ ID NO: 350 - DNA, 729 bp, Artificial sequence
  SC05-140
  CDS (1)..(729)
gaggtgcagctggtggagtctgggggagtcgcggtccagcctgggaggtccctgagactctcctgtgcggcgtctggattcagtttcagagattatggcatgcactgggtccgccaggctgcaggcaaggggctggagtgggtggcatttatatggcctcatggagtaaataggttttatgcagactcaatggagggccgattcaccatctccagagacgattccaagaatatgttgtatctagaaatgaataatctgagaaccgaagacacggctctatattactgtacaagagatcaagactatgtcccgagaaagtacttcgatctttggggccgtggcaccctggtcaccgtctcgagcggtacgggcggttcaggcggaaccggcagcggcactggcgggtcgacgtcctatgtgctgactcagccaccctcagtgtcagtggccccaggacagacggccaggattacctgtgggggaaacaacattggaagtaaaagtgtgcactggtaccagcagaagccaggccagtcccctgtgttggtcatgtatcaagataggaggcggccctcagggatccctgagcgattctctggctccaactctgggcacacagccactctgaccatcagcgggacccaggctatggatgaggctgactattactgtcaggcgtgggacagcagcactggggtcttcggaactgggacccagctcaccgtttta

SEQ ID NO: 351 - protein, 243 aa, Artificial sequence
  SC05-140
EVQLVESGGVAVQPGRSLRLSCAASGFSFRDYGMHWVRQAAGKGLEWVAFIWPHGVNRFYADSMEGRFTISRDDSKNMLYLEMNNLRTEDTALYYCTRDQDYVPRKYFDLWGRGTLVTVSSGTGGSGGTGSGTGGSTSYVLTQPPSVSVAPGQTARITCGGNNIGSKSVHWYQQKPGQSPVLVMYQDRRRPSGIPERFSGSNSGHTATLTISGTQAMDEADYYCQAWDSSTGVFGTGTQLTVL

SEQ ID NO: 352 - DNA, 741 bp, Artificial sequence
  SC05-157
  CDS (1)..(741)
gaggtgcagctggtggagtccggagcagaggtgaaaaagcccggggagtctctgaagatctcctgtaagggttctggatacagctttaccaactactggatcggctgggtgcgccagatgcccgggaaaggcctggagtggatggggatcgtctatcctggtgactctgataccagatacagcccgtccttccaaggccaggtcaccatctcagccgacaagtccatcagcaccgcctacctgcagtggagcagcctgaaggcctcggacaccgccgtgtattactgtgcgagacgcatggcagtggctggtagcgatgcttttgatatctggggccaagggacaatggtcaccgtctcgagcggtacgggcggttcaggcggaaccggcagcggcactggcgggtcgacgcaggctgtgctgactcagccgtcctcagcgtctgggacccccgggcagacggtcaccatctcttgttctgggagcacctccaacatcggaagtcataatgtaaactggtaccaacacctcccaggaacggcccccaaactcctcatctatattaataataagcggccctcaggggtccctgaccggttctctgggtccaagtctggctcctccgcctccctggccatcagtgggctccagtctgaggatgaggctgactattattgtgcagcctgggatgacagcctgagacgtccggttttcggcggagggacccagctcaccgtttta

SEQ ID NO: 353 - protein, 247 aa, Artificial sequence
  SC05-157
EVQLVESGAEVKKPGESLKISCKGSGYSFTNYWIGWVRQMPGKGLEWMGIVYPGDSDTRYSPSFQGQVTISADKSISTAYLQWSSLKASDTAVYYCARRMAVAGSDAFDIWGQGTMVTVSSGTGGSGGTGSGTGGSTQAVLTQPSSASGTPGQTVTISCSGSTSNIGSHNVNWYQHLPGTAPKLLIYINNKRPSGVPDRFSGSKSGSSASLAISGLQSEDEADYYCAAWDDSLRRPVFGGGTQLTVL

SEQ ID NO: 354 - DNA, 732 bp, Artificial sequence
  SC05-179
  CDS (1)..(732)
gaggtgcagctggtggagtctgggggaggcttggtcaagcctggagggtccctgggactctcctgtgcagcctctggattcttcttcagtgactactccatgagttggatccgccaggctccagggaaggggctggaatggctttcaaacattagtggtagtggtcactccacaaagtacgcagagtctatgaggggccgaatcaccatctccagagacaacgccaagaagtcgctgtctctgcaactgaacagcctgagagccgaggacacggctgtttatttctgtgtgcgagggggtggttatcgaatggacgtctggggccaagggaccacggtcaccgtctcgagcggtacgggcggttcaggcggaaccggcagcggcactggcgggtcgacgcagtctgccctgactcagcctcgctcagtgcccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccgtctctgggctccaggctgaggatgaggctgattattactgcagctcatatgcaggcagcaacaattttgtggtattcggcggagggaccaagctgaccgtccta

SEQ ID NO: 355 - protein, 244 aa, Artificial sequence
  SC05-179
EVQLVESGGGLVKPGGSLGLSCAASGFFFSDYSMSWIRQAPGKGLEWLSNISGSGHSTKYAESMRGRITISRDNAKKSLSLQLNSLRAEDTAVYFCVRGGGYRMDVWGQGTTVTVSSGTGGSGGTGSGTGGSTQSALTQPRSVPGSPGQSVTISCTGTSSDVGGYNYVSWYQQHPGKAPKLMIYDVSKRPSGVPDRFSGSKSGNTASLTVSGLQAEDEADYYCSSYAGSNNFVVFGGGTKLTVL

SEQ ID NO: 356 - DNA, 747 bp, Artificial sequence
  SC06-050
  CDS (1)..(747)
gaggtgcagctggtggagtctggacctgaggtgaagaagcctggggcctcagtgaaggtctcctgcgaggcttctggttacaacctggacaattatggtatcacctgggtgcgacaggcccctggacaagggcttgagtggctgggatggatcagcgcctacaatgctaagacagagtatggacagaggctccagggcagagtcaccatgaccacagacactgccacgagcacagcctacctggaactgaggagcctaagatctgacgacacggccgtctattattgtgcgagagttctcgggtatagagggggctggtacgacgagggtgatgcttttgatgtctggggccaagggacaatggtcaccgtctcgagcggtacgggcggttcaggcggaaccggcagcggcactggcgggtcgacggacatccagttgacccagtctccgtccttcctgtctgcatctgtaggagacagagtcaccatcacttgccgggccagtcagggcattagaagtcatttagcctggtatcagcagaaagcagggaaagcccctaagctcctgatctatgctgcatccactttgcaaagtggggtcccatcaaggttcagcggcagtggatctgggacagagttcactctcacaatcagcagcctgcagcctgacgattttgcagcttattactgtcaacaacttaatacttacccgatcaccttcggccaagggacacgactggagattaaa

SEQ ID NO: 357 - protein, 249 aa, Artificial sequence
  SC06-050
EVQLVESGPEVKKPGASVKVSCEASGYNLDNYGITWVRQAPGQGLEWLGWISAYNAKTEYGQRLQGRVTMTTDTATSTAYLELRSLRSDDTAVYYCARVLGYRGGWYDEGDAFDVWGQGTMVTVSSGTGGSGGTGSGTGGSTDIQLTQSPSFLSASVGDRVTITCRASQGIRSHLAWYQQKAGKAPKLLIYAASTLQSGVPSRFSGSGSGTEFTLTISSLQPDDFAAYYCQQLNTYPITFGQGTRLEIK

SEQ ID NO: 358 - DNA, 744 bp, Artificial sequence
  SC06-077
  CDS (1)..(744)
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagagggtggtgtgggcccagcttttgatatctggggccaagggacaatggtcaccgtctcgagcggtacgggcggttcaggcggaaccggcagcggcactggcgggtcgacggacatccagatgacccagtctccagactccctggctgtgtctctgggcgagagggccaccatcaactgcaagtccagccagagtgttttacacaactccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatggttcaccgtacacttttggccaggggaccaagctggagatcaaa

SEQ ID NO: 359 - protein, 248 aa, Artificial sequence
  SC06-077
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCAREGGVGPAFDIWGQGTMVTVSSGTGGSGGTGSGTGGSTDIQMTQSPDSLAVSLGERATINCKSSQSVLHNSNNKNYLAWYQQKPGQPPKLLIYWASTRESGVPDRFSGSGSGTDFTLTISSLQAEDVAVYYCQQYYGSPYTFGQGTKLEIK

SEQ ID NO: 360 - DNA, 726 bp, Artificial sequence
  SC06-079
  CDS (1)..(726)
gaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtactggtggtagcgcatactacgcagactccgtgaagggccggttcaccatctccagagacaattccaagaacacggtgtatctgcagatgaacagcctgagagccgaggacacggccgtatattactgtgcgaaaggacatagtagtgggaccaactggggccagggaaccctggtcaccgtctcgagcggtacgggcggttcaggcggaaccggcagcggcactggcgggtcgacgtcctatgtgctgactcagccaccctcagcgtctgggacccccgggcagagggtcaccatctcttgttctggaagctcctccaacatcggaagtaattttgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtgtgctattcggcggaggcacccagctgaccgtcctc

SEQ ID NO: 361 - protein, 242 aa, Artificial sequence
  SC06-079
EVQLVESGGGLVQPGGSLRLSCAASGFTFSSYAMSWVRQAPGKGLEWVSAISGTGGSAYYADSVKGRFTISRDNSKNTVYLQMNSLRAEDTAVYYCAKGHSSGTNWGQGTLVTVSSGTGGSGGTGSGTGGSTSYVLTQPPSASGTPGQRVTISCSGSSSNIGSNFVYWYQQLPGTAPKLLIYRNNQRPSGVPDRFSGSKSGTSASLAISGLRSEDEADYYCAAWDDSLSGVLFGGGTQLTVL

SEQ ID NO: 362 - DNA, 729 bp, Artificial sequence
  SC06-086
  CDS (1)..(729)
gaggtgcagctggtggagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagggtacgcagccaccgactacggtatggacgtctggggccaagggaccacggtcaccgtctcgagcggtacgggcggttcaggcggaaccggcagcggcactggcgggtcgacggacatccagttgacccagtctccttccaccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaa

SEQ ID NO: 363 - protein, 243 aa, Artificial sequence
  SC06-086
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARGYAATDYGMDVWGQGTTVTVSSGTGGSGGTGSGTGGSTDIQLTQSPSTLSASVGDRVTITCRASQSISSYLNWYQQKPGKAPKLLIYAASSLQSGVPSRFSGSGSGTDFTLTISSLQPEDFATYYCQQSYSTPFTFGPGTKVDIK

SEQ ID NO: 364 - DNA, 744 bp, Artificial sequence
  SC06-092
  CDS (1)..(744)
gaggtgcagctggtggagtctgggggaggcttggtacagccagggcggtccctgagactctcctgtacaggttctggattcacctttggtgattatgcaatgtcctggttccgccaggctccagggaaggggctggagtgggtaggtttcattagaaacaaggcatatggtgggacagcagaatacgccgcgtctgtgaaagacagattcatcatctcaagagatgattccaaaagcatcgcctatctgcaaatgaacagcctgaaaaccgaggacacagccgtgtattattgtgttaggcgagagtatgacactggctggcttgactactggggccagggaaccctggtcaccgtctcgagcggtacgggcggttcaggcggaaccggcagcggcactggcgggtcgacgcagtctgccctgactcagcctccctccgcgtccgggtctcctggacagtcggtcaccatctcctgcactggaaccagcagtgacgttggtggttataactatgtctcctggtaccaacggcacccaggcaaagcccccaaactcatgatttatgatgtcactgatcggccctcaggggtttctaatcgcttctctggctccaagtctggcaacacggcctccctgaccatctctgggctccaggctgaggacgaggctgattattactgcagctcatatacaagcagcagcacttccgcggttttcggcggagggaccaagctgaccgtccta

SEQ ID NO: 365 - protein, 248 aa, Artificial sequence
  SC06-092
EVQLVESGGGLVQPGRSLRLSCTGSGFTFGDYAMSWFRQAPGKGLEWVGFIRNKAYGGTAEYAASVKDRFIISRDDSKSIAYLQMNSLKTEDTAVYYCVRREYDTGWLDYWGQGTLVTVSSGTGGSGGTGSGTGGSTQSALTQPPSASGSPGQSVTISCTGTSSDVGGYNYVSWYQRHPGKAPKLMIYDVTDRPSGVSNRFSGSKSGNTASLTISGLQAEDEADYYCSSYTSSSTSAVFGGGTKLTVL

SEQ ID NO: 366 - DNA, 729 bp, Artificial sequence
  SC06-191
  CDS (1)..(729)
gaggtgcagctggtggagtctgggggaggcgtggtccagcctgggaggtccctgagactctcctgtgtagcgtctgaattcaccttcagtaattacggcatgcactgggtccgccaggctccaggcaaggggctggagtgggtggcagttatatggtatgatggaagtaatgaagactatgcagactccgtgaagggccgattcaccatctccagagacaattccaagaacacggtgtatctgcacatgaacagcctgagagccgaggacacggctgtgtatttctgtacaagaggacagtatagcagcacttggttccttgactactggggccagggaaccctggtcaccgtctcgagcggtacgggcggttcaggcggaaccggcagcggcactggcgggtcgacggacatccagttgacccagtctccttccaccctgtctgcatctgtaggagacagagtcaccatcacgtgccgggccagtcagagcattagtagctggttggcctggtatcagcaaaaaccagggaaagcccctaagctcctgatctataaggcgtctagtttagaaacaggggtcccatcaaggttcagcggcagtggatctgggacagatttcactctcaccatcagcagcctgcagcctgaagattttgcaacttactattgtcaacaggccaacagtttcccgctcactttcggcggagggaccaaagtggatatcaaa

SEQ ID NO: 367 - protein, 243 aa, Artificial sequence
  SC06-191
EVQLVESGGGVVQPGRSLRLSCVASEFTFSNYGMHWVRQAPGKGLEWVAVIWYDGSNEDYADSVKGRFTISRDNSKNTVYLHMNSLRAEDTAVYFCTRGQYSSTWFLDYWGQGTLVTVSSGTGGSGGTGSGTGGSTDIQLTQSPSTLSASVGDRVTITCRASQSISSWLAWYQQKPGKAPKLLIYKASSLETGVPSRFSGSGSGTDFTLTISSLQPEDFATYYCQQANSFPLTFGGGTKVDIK

SEQ ID NO: 368 - DNA, 723 bp, Artificial sequence
  SC06-195
  CDS (1)..(723)
gaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattcccagaacacgctgtatctgcaaatgaacagcctgagagccgaggacacggctgtgtattactgcacaagttatgcgatagcagctacccccggccagggaaccctggtcaccgtctcgagcggtacgggcggttcaggcggaaccggcagcggcactggcgggtcgacgcagtctgtcgtgacgcagccgccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggttgggtgttcggcggaggcacccagctgaccgtcctc

SEQ ID NO: 369 - protein, 241 aa, Artificial sequence
  SC06-195
EVQLVESGGGVVQPGRSLRLSCAASGFTFSSYGMHWVRQAPGKGLEWVAVIWYDGSNKYYADSVKGRFTISRDNSQNTLYLQMNSLRAEDTAVYYCTSYAIAATPGQGTLVTVSSGTGGSGGTGSGTGGSTQSVVTQPPSASGTPGQRVTISCSGSSSNIGSNYVYWYQQLPGTAPKLLIYRNNQRPSGVPDRFSGSKSGTSASLAISGLRSEDEADYYCAAWDDSLSGWVFGGGTQLTVL

SEQ ID NO: 370 - DNA, 729 bp, Artificial sequence
  SC06-198
  CDS (1)..(729)
cagctgcagctgcaggagtcgggcccaggactggtgaagccttcggagaccctgtccctcacctgcgctgtctctggttactccatcaccagtggttactattggggctgggtccggcagcccccagggaaggggctggagtggattgggagtatctatcacactgggagcacctactacaacccgtccctcaagagtcgagtcaccatatcagtagacacgtccaagaaccagttctccctgaagctgaactctctgaccgccgcagacacggccgtgtatttctgtgcgagccaaagtcctgcttttgatttctggggccaagggacaatggtcaccgtctcgagcggtacgggcggttcaggcggaaccggcagcggcactggcgggtcgacgcagtctgtgttgacgcagccgccctcagtgtctggggccccagggcagagggtcaccatctcctgcactgggagcagctccaacatcgggacaggttatgatgtacactggtaccagcagcttccaggaacagcccccaaactcctcatctatggtaacaacaatcggccctcaggggtccctgaccgattctctggctccaagtctggcacctcagcctccctggccatcactggactccaggctgaggatgaggctgattattactgtgcaacatgggatgacagcctgaatggttgggtgttcggcggagggaccaagctgaccgtccca

SEQ ID NO: 371 - protein, 243 aa, Artificial sequence
  SC06-198
QLQLQESGPGLVKPSETLSLTCAVSGYSITSGYYWGWVRQPPGKGLEWIGSIYHTGSTYYNPSLKSRVTISVDTSKNQFSLKLNSLTAADTAVYFCASQSPAFDFWGQGTMVTVSSGTGGSGGTGSGTGGSTQSVLTQPPSVSGAPGQRVTISCTGSSSNIGTGYDVHWYQQLPGTAPKLLIYGNNNRPSGVPDRFSGSKSGTSASLAITGLQAEDEADYYCATWDDSLNGWVFGGGTKLTVP

SEQ ID NO: 372 - DNA, 711 bp, Artificial sequence
  SC06-242
  CDS (1)..(711)
gaggtgcagttggtggagtcgggcccaggactggtgaagccttcggagaccctgtccctcacctgcactgtctctggtggctccatcagtagttactactggagctggatccggcagcccccagggaagggactggagtggattggctatatctattacactgggaccaccaactacaacccctccctcaacagtcgagtcaccatatcagcagacacgtccaagaaccagttctccctgaagctgagctctgtgaccgctgcggacacggccgtgtattactgtgcgagaggaggacagaccgcgggagtctggggcaaagggaccacggtcaccgtctcgagcggtacgggcggttcaggcggaaccggcagcggcactggcgggtcgacgcagtctgtgttgacgcagccgccctcggtgtcagtggccccaggacagacggccaggattacctgtgggggatacaacattggaagaaaaagtgtgcactggtaccagcagaagccaggcctggcccctgtgttggtcgtgtatgataatagcgaccggccctcagggatccctgcgcgattctctggctccaactctgggaacacggccaccctgaccatcagcgggacccaggctatggatgaggctgactattactgtcaggcgtgggacagaggcactgccgtcttcggaactgggaccaaggtcaccgtccta

SEQ ID NO: 373 - protein, 237 aa, Artificial sequence
  SC06-242
EVQLVESGPGLVKPSETLSLTCTVSGGSISSYYWSWIRQPPGKGLEWIGYIYYTGTTNYNPSLNSRVTISADTSKNQFSLKLSSVTAADTAVYYCARGGQTAGVWGKGTTVTVSSGTGGSGGTGSGTGGSTQSVLTQPPSVSVAPGQTARITCGGYNIGRKSVHWYQQKPGLAPVLVVYDNSDRPSGIPARFSGSNSGNTATLTISGTQAMDEADYYCQAWDRGTAVFGTGTKVTVL

SEQ ID NO: 374 - DNA, 735 bp, Artificial sequence
  SC06-246
  CDS (1)..(735)
gaggtgcagctggtggagtctggaggaggcttgatccagcctggggggtccctgagactctcctgtgcagcctctgggttcaccgtcagtagcgacttcatgacctgggtccgccaggctccagggagggggctggagtgggtctcacttatttatagcggtggtaaaacaaactacgcagactccgtgaagggccgattcaccatctccagagacaattccaggaacacgctgtatcttcaaatgaacagcctgagagccgaggacacggccgtgtattactgtgcgagatcggtgtgtagtactatcagctgctcaaaacttgacgactggggccagggaaccctggtcaccgtctcgagcggtacgggcggttcaggcggaaccggcagcggcactggcgggtcgacgcaggctgtgctgactcagccgtcctcggtgtcagtggccccaggacagacggccaggattacctgtgggggaaacaacattggaagaaaaagtgtgcactggtaccagcagaagccaggcctggcccctgtgctggtcgtcaatgataatagcgaccggccctcagggatccctgcgcgattctctggctccaactctgggaacacggccaccctgaccatcagcagggtcgaagccggggatgaggccgactattactgtcacgtgtggggtagtagtcgtgaccattatgtcttcggaactgggaccaaggtcaccgtccta

SEQ ID NO: 375 - protein, 245 aa, Artificial sequence
  SC06-246
EVQLVESGGGLIQPGGSLRLSCAASGFTVSSDFMTWVRQAPGRGLEWVSLIYSGGKTNYADSVKGRFTISRDNSRNTLYLQMNSLRAEDTAVYYCARSVCSTISCSKLDDWGQGTLVTVSSGTGGSGGTGSGTGGSTQAVLTQPSSVSVAPGQTARITCGGNNIGRKSVHWYQQKPGLAPVLVVNDNSDRPSGIPARFSGSNSGNTATLTISRVEAGDEADYYCHVWGSSRDHYVFGTGTKVTVL

SEQ ID NO: 376 - DNA, 735 bp, Artificial sequence
  SC06-388
  CDS (1)..(735)
gaggtgcagctggtggagactggagcagaggtgaaaaagcccggggagtctctgaggatctcctgtaagggttctggatacagctttaccagctactggatcgcctgggtgcgccagatgcccgggaaaggcctggagtggatgggagtcatctatcctggtgactctgatgccagatacagcccgtccttccaaggccaggtcaccatgtcagtcgacaagtccatcagcaccgcctacctgcagtggagcagcctgaaggcctcggacaccgccatgtattactgtgcgaaacttcggtctaagaacacaggacttgactactggggccagggaaccctggtcaccgtctcgagcggtacgggcggttcaggcggaaccggcagcggcactggcgggtcgacgcagtctgccctgactcagcctccctccgcgtccgggtctcctggacagtcagtcaccatctcctgcactggaaccagcagtgacgttggtggttataactttgtctcctggtaccaacagcacccaggcaaagcccccaaactcatgatttatgaggtcagtaatcggccctcgggggtccctgatcgcttctctggctccaagtctggcaacacggcctccctgaccgtctctgggctccaggctgaggatgaggctgattattactgcagctcatatgcaggcaacaacaatttggcgttcggcggaggcacccagctgaccgtcctc

SEQ ID NO: 377 - protein, 245 aa, Artificial sequence
  SC06-388
EVQLVETGAEVKKPGESLRISCKGSGYSFTSYWIAWVRQMPGKGLEWMGVIYPGDSDARYSPSFQGQVTMSVDKSISTAYLQWSSLKASDTAMYYCAKLRSKNTGLDYWGQGTLVTVSSGTGGSGGTGSGTGGSTQSALTQPPSASGSPGQSVTISCTGTSSDVGGYNFVSWYQQHPGKAPKLMIYEVSNRPSGVPDRFSGSKSGNTASLTVSGLQAEDEADYYCSSYAGNNNLAFGGGTQLTVL

SEQ ID NO: 378 - DNA, 735 bp, Artificial sequence
  SC06-389
  CDS (1)..(735)
caggtccagctggtacagtctggagcagaggtgaaaaagcccggggagtctctgaagatctcctgtaagggttctggatacagctttagtacatactggatcggctgggtgcgccagatgcccgggaaaggcctggagtggatggggatcatttatcctggtgactctgataccaggtacagcccgtccttccaaggccaggtcaccatctcagccgacaagtccatcagcaccgcccacctgcagtggagcagcctgaaggcctcggacaccgccatgtattactgtgcgaggccaggaccccgtggatacaaccatggctttgactactggggccagggaaccctggtcaccgtctcgagcggtacgggcggttcaggcggaaccggcagcggcactggcgggtcgacgtcttctgagctgactcaggaccctgctgagtctgtggccttgggacagacagtcaagatcacatgccaaggagacagtctcagaaggtattatgcaagttggtaccagcagaagccaggacaggcccctgttcttgtcatctatggcaaaaacaaccggccctcagggatcccagaccgattctctggctccaggtcaggaaacacagcttccttgaccataactggggctcaggcggaagatgaggctgtctattactgtaactcccgggacagcagtggtaactctgtggtcttcggcggagggaccaagctgaccgtccta

SEQ ID NO: 379 - protein, 245 aa, Artificial sequence
  SC06-389
QVQLVQSGAEVKKPGESLKISCKGSGYSFSTYWIGWVRQMPGKGLEWMGIIYPGDSDTRYSPSFQGQVTISADKSISTAHLQWSSLKASDTAMYYCARPGPRGYNHGFDYWGQGTLVTVSSGTGGSGGTGSGTGGSTSSELTQDPAESVALGQTVKITCQGDSLRRYYASWYQQKPGQAPVLVIYGKNNRPSGIPDRFSGSRSGNTASLTITGAQAEDEAVYYCNSRDSSGNSVVFGGGTKLTVL

SEQ ID NO: 380 - DNA, 735 bp, Artificial sequence
  SC06-396
  CDS (1)..(735)
cagatgcagctggtgcagtctggagcagaggtgaaaaagtccggggagtctctgaagatctcctgtaagggttctggatacagctttagcacctactggatcggctgggtgcgccagatgcccgggaaaggcctggagtggatggggatcatctatcctggtgactctgataccagatacaacccgtccttccaaggccaggtcaccatctcagccgacaagtccatcagcaccgcctacctgcagtggagtagcctgaaggcctcggacaccgccatgtattattgtgcgagacggtccgctcggggcgggaactggtacttcgatctctggggccgtggcaccctggtcaccgtctcgagcggtacgggcggttcaggcggaaccggcagcggcactggcgggtcgacggaaattgtgttgacacagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcaatatggtaggtcacctctcactttcggcggagggaccaaggtggagatcaaa

SEQ ID NO: 381 - protein, 245 aa, Artificial sequence
  SC06-396
QMQLVQSGAEVKKSGESLKISCKGSGYSFSTYWIGWVRQMPGKGLEWMGIIYPGDSDTRYNPSFQGQVTISADKSISTAYLQWSSLKASDTAMYYCARRSARGGNWYFDLWGRGTLVTVSSGTGGSGGTGSGTGGSTEIVLTQSPGTLSLSPGERATLSCRASQSVSSSYLAWYQQKPGQAPRLLIYGASSRATGIPDRFSGSGSGTDFTLTISRLEPEDFAVYYCQQYGRSPLTFGGGTKVEIK

SEQ ID NO: 382 - DNA, 765 bp, Artificial sequence
  SC06-402
  CDS (1)..(765)
caggtccagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagatgggggggggtttgtagtagtaccagctgcccgaaccgtgatgcttttgatatctggggccaagggacaatggtcaccgtctcgagcggtacgggcggttcaggcggaaccggcagcggcactggcgggtcgacgcagtctgccctgactcagcctcgctcagtgtccgggtctcctggacagtcagtcaccatctcctgcactggaaccagcagtgatgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgagtttcactgcagctcatacagaagcagcggcgcttcccctgtggttttcggcggagggaccaagctgaccgtccta

SEQ ID NO: 383 - protein, 255 aa, Artificial sequence
  SC06-402
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWGGVCSSTSCPNRDAFDIWGQGTMVTVSSGTGGSGGTGSGTGGSTQSALTQPRSVSGSPGQSVTISCTGTSSDVGGYNYVSWYQQHPGKAPKLMIYDVSNRPSGVSNRFSGSKSGNTASLTISGLQAEDEAEFHCSSYRSSGASPVVFGGGTKLTVL

SEQ ID NO: 384 - DNA, 747 bp, Artificial sequence
  SC06-409
  CDS (1)..(747)
gaggtccagttggtgcagtctggagcagaggtgaaaaagcccggggagtctctgaagatctcctgtaagggttctggatacagctttaccaactactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacatacgcagaacaaaaatgggatgaatacttttgatatctggggccaagggacaatggtcaccgtctcgagcggtacgggcggttcaggcggaaccggcagcggcactggcgggtcgacgcagtctgccctgactcagcctccctccgcgtccgggtctcctggacagtcagtcaccatctcctgcactggaaccagcagtgacattggtggttataactatgtctcctggtaccaacagcacccaggcaaagcccccaaactcatgatttatgaggtcagtaatcggcccccaggggtttctaatcgcttctctggctccaagtctggcaacacggcctccctgaccatctctgggctccaggctgaggacgaggctgattattactgcagctcatactcaaccaccaccacccgagtgatattcggcggagggaccaagctgaccgtccta

SEQ ID NO: 385 - protein, 249 aa, Artificial sequence
  SC06-409
EVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHTQNKNGMNTFDIWGQGTMVTVSSGTGGSGGTGSGTGGSTQSALTQPPSASGSPGQSVTISCTGTSSDIGGYNYVSWYQQHPGKAPKLMIYEVSNRPPGVSNRFSGSKSGNTASLTISGLQAEDEADYYCSSYSTTTTRVIFGGGTKLTVL

SEQ ID NO: 386 - DNA, 726 bp, Artificial sequence
  SC06-415
  CDS (1)..(726)
gaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactcactgtatctgcaaatgaacagcctgagagccgaggactcggctgtgtattactgtgcgaggggtggacagaggtttgacttctggggccagggaaccctggtcaccgtctcgagcggtacgggcggttcaggcggaaccggcagcggcactggcgggtcgacgcagtctgccctgactcagcctccctccgcgtccgggtctcctggacagtcagtcaccatctcctgcactggaaccagcagtgacgttggtggttataactatgtctcctggtaccaacaactgccagggaaagcccccaaactattgatttatgatgtcaataatcggccgtctggggtctctaatcgcttctctggctccaagtcgggaaacacggcctccctgaccatctctgggctccaggctgaggacgaggctgagtattactgcggctcaagtgtaggcagcagactaaggattttcggcggagggaccaagctgaccgtccta

SEQ ID NO: 387 - protein, 242 aa, Artificial sequence
  SC06-415
EVQLVESGGGLVQPGRSLRLSCAASGFTFDDYAMHWVRQAPGKGLEWVSGISWNSGSIGYADSVKGRFTISRDNAKNSLYLQMNSLRAEDSAVYYCARGGQRFDFWGQGTLVTVSSGTGGSGGTGSGTGGSTQSALTQPPSASGSPGQSVTISCTGTSSDVGGYNYVSWYQQLPGKAPKLLIYDVNNRPSGVSNRFSGSKSGNTASLTISGLQAEDEAEYYCGSSVGSRLRIFGGGTKLTVL

SEQ ID NO: 388 - DNA, 738 bp, Artificial sequence
  SC06-421
  CDS (1)..(738)
gaggtgcagctggtggagtctggagcagaggtgaaaaagcccggggagtctctgaagatctcctgtaagggttctggatacagctttaccagtcactggatcggctgggtgcgccagatgcccgggaaaggcctggagtggatggggatcatctatcctggtgactctgataccagatacagcccgtccttccaaggccaggtcaccatctcagtcgacaagtccatcagcaccgcctacctgcagtggagcagcctgaaggcctcggacaccgccatgtattactgtgcgagactcgggagcagtcgctggtcgcactttgactactggggccagggaaccctggtcaccgtctcgagcggtacgggcggttcaggcggaaccggcagcggcactggcgggtcgacgcagtctgccctgactcagcctccctccgcgtccgggtctcctggacagtcagtcaccatctcctgcactggaaccagcactgacgttggtggttataactatgtctcctggtaccaacatcacccaggcaaagcccccaaactcgtgatttatggggtcagtaagcggccctcaagggtccctgatcgcttctctggctccaagtctggcaacacggcctccctgaccgtctctgggctccaggctgaggatgaggctgattattactgcagctcatatgcaggcagcaacaatttggtgttcggcggagggaccaagctgaccgtccta

SEQ ID NO: 389 - protein, 246 aa, Artificial sequence
  SC06-421
EVQLVESGAEVKKPGESLKISCKGSGYSFTSHWIGWVRQMPGKGLEWMGIIYPGDSDTRYSPSFQGQVTISVDKSISTAYLQWSSLKASDTAMYYCARLGSSRWSHFDYWGQGTLVTVSSGTGGSGGTGSGTGGSTQSALTQPPSASGSPGQSVTISCTGTSTDVGGYNYVSWYQHHPGKAPKLVIYGVSKRPSRVPDRFSGSKSGNTASLTVSGLQAEDEADYYCSSYAGSNNLVFGGGTKLTVL

SEQ ID NO: 390 - DNA, 747 bp, Artificial sequence
  SC06-429
  CDS (1)..(747)
caggtccagctggtacagtctggggcagaggtgaaaaaccccggggagtctctgaagatctcctgtaagggctctggatacacttttaccagctactggatcggctgggtgcgccagatgcccgggaaaggcctggagtggatgggcagcatctatcctggtgactctgataccagatacagcccgtccttccaaggccaggtcaccatctcagtcgacaagtccatcagcaccgcctacctgcagtggagcagcctgaaggcctcggacaccgccatgtattactgtgcgagacagtatcgagccggcagtaccaccaggttcgacccctggggccagggaaccctggtcaccgtctcgagcggtacgggcggttcaggcggaaccggcagcggcactggcgggtcgacggatgttgtgatgactcagtctccactctccctgcccgtcacccctggagagccggcctccatctcctgcaggtctagtcagagcctccggcatagaaatggaaacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggaatttattactgcatgcaagctctacaaactcctctcactttcggcggagggaccaaggtggaaatcaaa

SEQ ID NO: 391 - protein, 249 aa, Artificial sequence
  SC06-429
QVQLVQSGAEVKNPGESLKISCKGSGYTFTSYWIGWVRQMPGKGLEWMGSIYPGDSDTRYSPSFQGQVTISVDKSISTAYLQWSSLKASDTAMYYCARQYRAGSTTRFDPWGQGTLVTVSSGTGGSGGTGSGTGGSTDVVMTQSPLSLPVTPGEPASISCRSSQSLRHRNGNNYLDWYLQKPGQSPQLLIYLGSNRASGVPDRFSGSGSGTDFTLKISRVEAEDVGIYYCMQALQTPLTFGGGTKVEIK

SEQ ID NO: 392 - DNA, 738 bp, Artificial sequence
  SC06-432
  CDS (1)..(738)
cagctgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgaccgccgcggacacggccgtctattactgtgcgagagaacggatactggatcgtatgaatgactactggggccagggaaccctggtcaccgtctcgagcggtacgggcggttcaggcggaaccggcagcggcactggcgggtcgacgcagtctgtcgtgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaaatctggcacctcagcctccctggccatcactgggctccaggctgaggatgaggctgattattactgccagtcctctgacagcagcctgaatattttgttcggcggagggaccaagctgaccgtccta

SEQ ID NO: 393 - protein, 246 aa, Artificial sequence
  SC06-432
QLQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARERILDRMNDYWGQGTLVTVSSGTGGSGGTGSGTGGSTQSVVTQPPSVSGAPGQRVTISCTGSSSNIGAGYDVHWYQQLPGTAPKLLIYGNSNRPSGVPDRFSGSKSGTSASLAITGLQAEDEADYYCQSSDSSLNILFGGGTKLTVL

SEQ ID NO: 394 - DNA, 1353 bp, Homo sapiens
  CDS (1)..(1353)
gaggtgcagctggtggagtctgggggagtcgcggtccagcctgggaggtccctgagactctcctgtgcggcgtctggattcagtttcagagattatggcatgcactgggtccgccaggctgcaggcaaggggctggagtgggtggcatttatatggcctcatggagtaaataggttttatgcagactcaatggagggccgattcaccatctccagagacgattccaagaatatgttgtatctagaaatgaataatctgagaaccgaagacacggctctatattactgtacaagagatcaagactatgtcccgagaaagtacttcgatctttggggccgtggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 395 - protein, 451 aa, Homo sapiens
EVQLVESGGVAVQPGRSLRLSCAASGFSFRDYGMHWVRQAAGKGLEWVAFIWPHGVNRFYADSMEGRFTISRDDSKNMLYLEMNNLRTEDTALYYCTRDQDYVPRKYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 396 - DNA, 1353 bp, Homo sapiens
  CDS (1)..(1353)
gaggtgcagctggtggagtccggagcagaggtgaaaaagcccggggagtctctgaagatctcctgtaagggttctggatacagctttaccaactactggatcggctgggtgcgccagatgcccgggaaaggcctggagtggatggggatcgtctatcctggtgactctgataccagatacagcccgtccttccaaggccaggtcaccatctcagccgacaagtccatcagcaccgcctacctgcagtggagcagcctgaaggcctcggacaccgccgtgtattactgtgcgagacgcatggcagtggctggtagcgatgcttttgatatctggggccaagggacaatggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 397 - protein, 451 aa, Homo sapiens
EVQLVESGAEVKKPGESLKISCKGSGYSFTNYWIGWVRQMPGKGLEWMGIVYPGDSDTRYSPSFQGQVTISADKSISTAYLQWSSLKASDTAVYYCARRMAVAGSDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 398 - DNA, 1341 bp, Homo sapiens
  CDS (1)..(1341)
gaggtgcagctggtggagtctgggggaggcttggtcaagcctggagggtccctgggactctcctgtgcagcctctggattcttcttcagtgactactccatgagttggatccgccaggctccagggaaggggctggaatggctttcaaacattagtggtagtggtcactccacaaagtacgcagagtctatgaggggccgaatcaccatctccagagacaacgccaagaagtcgctgtctctgcaactgaacagcctgagagccgaggacacggctgtttatttctgtgtgcgagggggtggttatcgaatggacgtctggggccaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 399 - protein, 447 aa, Homo sapiens
EVQLVESGGGLVKPGGSLGLSCAASGFFFSDYSMSWIRQAPGKGLEWLSNISGSGHSTKYAESMRGRITISRDNAKKSLSLQLNSLRAEDTAVYFCVRGGGYRMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 400 - DNA, 1368 bp, Homo sapiens
  CDS (1)..(1368)
gaggtgcagctggtggagtctggacctgaggtgaagaagcctggggcctcagtgaaggtctcctgcgaggcttctggttacaacctggacaattatggtatcacctgggtgcgacaggcccctggacaagggcttgagtggctgggatggatcagcgcctacaatgctaagacagagtatggacagaggctccagggcagagtcaccatgaccacagacactgccacgagcacagcctacctggaactgaggagcctaagatctgacgacacggccgtctattattgtgcgagagttctcgggtatagagggggctggtacgacgagggtgatgcttttgatgtctggggccaagggacaatggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 401 - protein, 456 aa, Homo sapiens
EVQLVESGPEVKKPGASVKVSCEASGYNLDNYGITWVRQAPGQGLEWLGWISAYNAKTEYGQRLQGRVTMTTDTATSTAYLELRSLRSDDTAVYYCARVLGYRGGWYDEGDAFDVWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402 - DNA, 1347 bp, Homo sapiens
  CDS (1)..(1347)
caggtgcagctggtgcagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagagggtggtgtgggcccagcttttgatatctggggccaagggacaatggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 403 - protein, 449 aa, Homo sapiens
QVQLVQSGAEVKKPGSSVKVSCKASGGTFSSYAISWVRQAPGQGLEWMGGIIPIFGTANYAQKFQGRVTITADESTSTAYMELSSLRSEDTAVYYCAREGGVGPAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 404 - DNA, 1338 bp, Homo sapiens
  CDS (1)..(1338)
gaggtgcagctggtggagtctgggggaggcttggtacagcctggggggtccctgagactctcctgtgcagcctctggattcacctttagcagctatgccatgagctgggtccgccaggctccagggaaggggctggagtgggtctcagctattagtggtactggtggtagcgcatactacgcagactccgtgaagggccggttcaccatctccagagacaattccaagaacacggtgtatctgcagatgaacagcctgagagccgaggacacggccgtatattactgtgcgaaaggacatagtagtgggaccaactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 405 - protein, 446 aa, Homo sapiens
EVQLVESGGGLVQPGGSLRLSCAASGFTFSSYAMSWVRQAPGKGLEWVSAISGTGGSAYYADSVKGRFTISRDNSKNTVYLQMNSLRAEDTAVYYCAKGHSSGTNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 406 - DNA, 1350 bp, Homo sapiens
  CDS (1)..(1350)
gaggtgcagctggtggagtctggggctgaggtgaagaagcctgggtcctcggtgaaggtctcctgcaaggcttctggaggcaccttcagcagctatgctatcagctgggtgcgacaggcccctggacaagggcttgagtggatgggagggatcatccctatctttggtacagcaaactacgcacagaagttccagggcagagtcacgattaccgcggacgaatccacgagcacagcctacatggagctgagcagcctgagatctgaggacacggccgtgtattactgtgcgagagggtacgcagccaccgactacggtatggacgtctggggccaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 407 - protein, 450 aa, Homo sapiens
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARGYAATDYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 408 - DNA, 1353 bp, Homo sapiens
  CDS (1)..(1353)
gaggtgcagctggtggagtctgggggaggcttggtacagccagggcggtccctgagactctcctgtacaggttctggattcacctttggtgattatgcaatgtcctggttccgccaggctccagggaaggggctggagtgggtaggtttcattagaaacaaggcatatggtgggacagcagaatacgccgcgtctgtgaaagacagattcatcatctcaagagatgattccaaaagcatcgcctatctgcaaatgaacagcctgaaaaccgaggacacagccgtgtattattgtgttaggcgagagtatgacactggctggcttgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 409 - protein, 451 aa, Homo sapiens
EVQLVESGGGLVQPGRSLRLSCTGSGFTFGDYAMSWFRQAPGKGLEWVGFIRNKAYGGTAEYAASVKDRFIISRDDSKSIAYLQMNSLKTEDTAVYYCVRREYDTGWLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 410 - DNA, 1350 bp, Homo sapiens
  CDS (1)..(1350)
gaggtgcagctggtggagtctgggggaggcgtggtccagcctgggaggtccctgagactctcctgtgtagcgtctgaattcaccttcagtaattacggcatgcactgggtccgccaggctccaggcaaggggctggagtgggtggcagttatatggtatgatggaagtaatgaagactatgcagactccgtgaagggccgattcaccatctccagagacaattccaagaacacggtgtatctgcacatgaacagcctgagagccgaggacacggctgtgtatttctgtacaagaggacagtatagcagcacttggttccttgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 411 - protein, 450 aa, Homo sapiens
EVQLVESGGGVVQPGRSLRLSCVASEFTFSNYGMHWVRQAPGKGLEWVAVIWYDGSNEDYADSVKGRFTISRDNSKNTVYLHMNSLRAEDTAVYFCTRGQYSSTWFLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 412 - DNA, 1335 bp, Homo sapiens
  CDS (1)..(1335)
gaggtgcagctggtggagtctgggggaggcgtggtccagcctgggaggtccctgagactctcctgtgcagcgtctggattcaccttcagtagctatggcatgcactgggtccgccaggctccaggcaaggggctggagtgggtggcagttatatggtatgatggaagtaataaatactatgcagactccgtgaagggccgattcaccatctccagagacaattcccagaacacgctgtatctgcaaatgaacagcctgagagccgaggacacggctgtgtattactgcacaagttatgcgatagcagctacccccggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 413 - protein, 445 aa, Homo sapiens
EVQLVESGGGVVQPGRSLRLSCAASGFTFSSYGMHWVRQAPGKGLEWVAVIWYDGSNKYYADSVKGRFTISRDNSQNTLYLQMNSLRAEDTAVYYCTSYAIAATPGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 414 - DNA, 1338 bp, Homo sapiens
  CDS (1)..(1338)
cagctgcagctgcaggagtcgggcccaggactggtgaagccttcggagaccctgtccctcacctgcgctgtctctggttactccatcaccagtggttactattggggctgggtccggcagcccccagggaaggggctggagtggattgggagtatctatcacactgggagcacctactacaacccgtccctcaagagtcgagtcaccatatcagtagacacgtccaagaaccagttctccctgaagctgaactctctgaccgccgcagacacggccgtgtatttctgtgcgagccaaagtcctgcttttgatttctggggccaagggacaatggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 415 - protein, 446 aa, Homo sapiens
QLQLQESGPGLVKPSETLSLTCAVSGYSITSGYYWGWVRQPPGKGLEWIGSIYHTGSTYYNPSLKSRVTISVDTSKNQFSLKLNSLTAADTAVYFCASQSPAFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 416 - DNA, 1335 bp, Homo sapiens
  CDS (1)..(1335)
gaggtgcagttggtggagtcgggcccaggactggtgaagccttcggagaccctgtccctcacctgcactgtctctggtggctccatcagtagttactactggagctggatccggcagcccccagggaagggactggagtggattggctatatctattacactgggaccaccaactacaacccctccctcaacagtcgagtcaccatatcagcagacacgtccaagaaccagttctccctgaagctgagctctgtgaccgctgcggacacggccgtgtattactgtgcgagaggaggacagaccgcgggagtctggggcaaagggaccacggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 417 - protein, 445 aa, Homo sapiens
EVQLVESGPGLVKPSETLSLTCTVSGGSISSYYWSWIRQPPGKGLEWIGYIYYTGTTNYNPSLNSRVTISADTSKNQFSLKLSSVTAADTAVYYCARGGQTAGVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 418 - DNA, 1353 bp, Homo sapiens
  CDS (1)..(1353)
gaggtgcagctggtggagtctggaggaggcttgatccagcctggggggtccctgagactctcctgtgcagcctctgggttcaccgtcagtagcgacttcatgacctgggtccgccaggctccagggagggggctggagtgggtctcacttatttatagcggtggtaaaacaaactacgcagactccgtgaagggccgattcaccatctccagagacaattccaggaacacgctgtatcttcaaatgaacagcctgagagccgaggacacggccgtgtattactgtgcgagatcggtgtgtagtactatcagctgctcaaaacttgacgactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 419 - protein, 451 aa, Homo sapiens
EVQLVESGGGLIQPGGSLRLSCAASGFTVSSDFMTWVRQAPGRGLEWVSLIYSGGKTNYADSVKGRFTISRDNSRNTLYLQMNSLRAEDTAVYYCARSVCSTISCSKLDDWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 420 - DNA, 1347 bp, Homo sapiens
  CDS (1)..(1347)
gaggtgcagctggtggagactggagcagaggtgaaaaagcccggggagtctctgaggatctcctgtaagggttctggatacagctttaccagctactggatcgcctgggtgcgccagatgcccgggaaaggcctggagtggatgggagtcatctatcctggtgactctgatgccagatacagcccgtccttccaaggccaggtcaccatgtcagtcgacaagtccatcagcaccgcctacctgcagtggagcagcctgaaggcctcggacaccgccatgtattactgtgcgaaacttcggtctaagaacacaggacttgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 421 - protein, 449 aa, Homo sapiens
EVQLVETGAEVKKPGESLRISCKGSGYSFTSYWIAWVRQMPGKGLEWMGVIYPGDSDARYSPSFQGQVTMSVDKSISTAYLQWSSLKASDTAMYYCAKLRSKNTGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 422 - DNA, 1353 bp, Homo sapiens
  CDS (1)..(1353)
caggtccagctggtacagtctggagcagaggtgaaaaagcccggggagtctctgaagatctcctgtaagggttctggatacagctttagtacatactggatcggctgggtgcgccagatgcccgggaaaggcctggagtggatggggatcatttatcctggtgactctgataccaggtacagcccgtccttccaaggccaggtcaccatctcagccgacaagtccatcagcaccgcccacctgcagtggagcagcctgaaggcctcggacaccgccatgtattactgtgcgaggccaggaccccgtggatacaaccatggctttgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 423 - protein, 451 aa, Homo sapiens
QVQLVQSGAEVKKPGESLKISCKGSGYSFSTYWIGWVRQMPGKGLEWMGIIYPGDSDTRYSPSFQGQVTISADKSISTAHLQWSSLKASDTAMYYCARPGPRGYNHGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 424 - DNA, 1353 bp, Homo sapiens
  CDS (1)..(1353)
cagatgcagctggtgcagtctggagcagaggtgaaaaagtccggggagtctctgaagatctcctgtaagggttctggatacagctttagcacctactggatcggctgggtgcgccagatgcccgggaaaggcctggagtggatggggatcatctatcctggtgactctgataccagatacaacccgtccttccaaggccaggtcaccatctcagccgacaagtccatcagcaccgcctacctgcagtggagtagcctgaaggcctcggacaccgccatgtattattgtgcgagacggtccgctcggggcgggaactggtacttcgatctctggggccgtggcaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 425 - protein, 451 aa, Homo sapiens
QMQLVQSGAEVKKSGESLKISCKGSGYSFSTYWIGWVRQMPGKGLEWMGIIYPGDSDTRYNPSFQGQVTISADKSISTAYLQWSSLKASDTAMYYCARRSARGGNWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 426 - DNA, 1371 bp, Homo sapiens
  CDS (1)..(1371)
caggtccagctggtgcagtctggagcagaggtgaaaaagccgggggagtctctgaagatctcctgtaagggttctggatacagctttaccagctactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagatgggggggggtttgtagtagtaccagctgcccgaaccgtgatgcttttgatatctggggccaagggacaatggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 427 - protein, 457 aa, Homo sapiens
QVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARWGGVCSSTSCPNRDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 428 - DNA, 1356 bp, Homo sapiens
  CDS (1)..(1356)
gaggtccagttggtgcagtctggagcagaggtgaaaaagcccggggagtctctgaagatctcctgtaagggttctggatacagctttaccaactactggatcggctgggtgcgccagatgcccgggaaaggcctggagtggatggggatcatctatcctggtgactctgataccagatacagcccgtccttccaaggccaggtcaccatctcagccgacaagtccatcagcaccgcctacctgcagtggagcagcctgaaggcctcggacaccgccatgtattactgtgcgagacatacgcagaacaaaaatgggatgaatacttttgatatctggggccaagggacaatggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 429 - protein, 452 aa, Homo sapiens
EVQLVQSGAEVKKPGESLKISCKGSGYSFTNYWIGWVRQMPGKGLEWMGIIYPGDSDTRYSPSFQGQVTISADKSISTAYLQWSSLKASDTAMYYCARHTQNKNGMNTFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 430 - DNA, 1338 bp, Homo sapiens
  CDS (1)..(1338)
gaggtgcagctggtggagtctgggggaggcttggtacagcctggcaggtccctgagactctcctgtgcagcctctggattcacctttgatgattatgccatgcactgggtccggcaagctccagggaagggcctggagtgggtctcaggtattagttggaatagtggtagcataggctatgcggactctgtgaagggccgattcaccatctccagagacaacgccaagaactcactgtatctgcaaatgaacagcctgagagccgaggactcggctgtgtattactgtgcgaggggtggacagaggtttgacttctggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 431 - protein, 446 aa, Homo sapiens
EVQLVESGGGLVQPGRSLRLSCAASGFTFDDYAMHWVRQAPGKGLEWVSGISWNSGSIGYADSVKGRFTISRDNAKNSLYLQMNSLRAEDSAVYYCARGGQRFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 432 - DNA, 1350 bp, Homo sapiens
  CDS (1)..(1350)
gaggtgcagctggtggagtctggagcagaggtgaaaaagcccggggagtctctgaagatctcctgtaagggttctggatacagctttaccagtcactggatcggctgggtgcgccagatgcccgggaaaggcctggagtggatggggatcatctatcctggtgactctgataccagatacagcccgtccttccaaggccaggtcaccatctcagtcgacaagtccatcagcaccgcctacctgcagtggagcagcctgaaggcctcggacaccgccatgtattactgtgcgagactcgggagcagtcgctggtcgcactttgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 433 - protein, 450 aa, Homo sapiens
EVQLVESGAEVKKPGESLKISCKGSGYSFTSHWIGWVRQMPGKGLEWMGIIYPGDSDTRYSPSFQGQVTISVDKSISTAYLQWSSLKASDTAMYYCARLGSSRWSHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 434 - DNA, 1353 bp, Homo sapiens
  CDS (1)..(1353)
caggtccagctggtacagtctggggcagaggtgaaaaaccccggggagtctctgaagatctcctgtaagggctctggatacacttttaccagctactggatcggctgggtgcgccagatgcccgggaaaggcctggagtggatgggcagcatctatcctggtgactctgataccagatacagcccgtccttccaaggccaggtcaccatctcagtcgacaagtccatcagcaccgcctacctgcagtggagcagcctgaaggcctcggacaccgccatgtattactgtgcgagacagtatcgagccggcagtaccaccaggttcgacccctggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 435 - protein, 451 aa, Homo sapiens
QVQLVQSGAEVKNPGESLKISCKGSGYTFTSYWIGWVRQMPGKGLEWMGSIYPGDSDTRYSPSFQGQVTISVDKSISTAYLQWSSLKASDTAMYYCARQYRAGSTTRFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 436 - DNA, 1350 bp, Homo sapiens
  CDS (1)..(1350)
cagctgcagctgcaggagtcgggcccaggactggtgaagccttcacagaccctgtccctcacctgcactgtctctggtggctccatcagcagtggtggttactactggagctggatccgccagcacccagggaagggcctggagtggattgggtacatctattacagtgggagcacctactacaacccgtccctcaagagtcgagttaccatatcagtagacacgtctaagaaccagttctccctgaagctgagctctgtgaccgccgcggacacggccgtctattactgtgcgagagaacggatactggatcgtatgaatgactactggggccagggaaccctggtcaccgtctcgagtgctagcaccaagggccccagcgtgttccccctggcccccagcagcaagagcaccagcggcggcacagccgccctgggctgcctggtgaaggactacttccccgagcccgtgaccgtgagctggaacagcggcgccttgaccagcggcgtgcacaccttccccgccgtgctgcagagcagcggcctgtacagcctgagcagcgtggtgaccgtgcccagcagcagcctgggcacccagacctacatctgcaacgtgaaccacaagcccagcaacaccaaggtggacaaacgcgtggagcccaagagctgcgacaagacccacacctgccccccctgccctgcccccgagctgctgggcggaccctccgtgttcctgttcccccccaagcccaaggacaccctcatgatcagccggacccccgaggtgacctgcgtggtggtggacgtgagccacgaggaccccgaggtgaagttcaactggtacgtggacggcgtggaggtgcacaacgccaagaccaagccccgggaggagcagtacaacagcacctaccgggtggtgagcgtgctcaccgtgctgcaccaggactggctgaacggcaaggagtacaagtgcaaggtgagcaacaaggccctgcctgcccccatcgagaagaccatcagcaaggccaagggccagccccgggagccccaggtgtacaccctgccccccagccgggaggagatgaccaagaaccaggtgtccctcacctgtctggtgaagggcttctaccccagcgacatcgccgtggagtgggagagcaacggccagcccgagaacaactacaagaccaccccccctgtgctggacagcgacggcagcttcttcctgtacagcaagctcaccgtggacaagagccggtggcagcagggcaacgtgttcagctgcagcgtgatgcacgaggccctgcacaaccactacacccagaagagcctgagcctgagccccggcaag

SEQ ID NO: 437 - protein, 450 aa, Homo sapiens
QLQLQESGPGLVKPSQTLSLTCTVSGGSISSGGYYWSWIRQHPGKGLEWIGYIYYSGSTYYNPSLKSRVTISVDTSKNQFSLKLSSVTAADTAVYYCARERILDRMNDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 438 - DNA, 648 bp, Homo sapiens
  CDS (1)..(648)
tcctatgtgctgactcagccaccctcagtgtcagtggccccaggacagacggccaggattacctgtgggggaaacaacattggaagtaaaagtgtgcactggtaccagcagaagccaggccagtcccctgtgttggtcatgtatcaagataggaggcggccctcagggatccctgagcgattctctggctccaactctgggcacacagccactctgaccatcagcgggacccaggctatggatgaggctgactattactgtcaggcgtgggacagcagcactggggtcttcggaactgggacccagctcaccgttttaagtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 439 - protein, 216 aa, Homo sapiens
SYVLTQPPSVSVAPGQTARITCGGNNIGSKSVHWYQQKPGQSPVLVMYQDRRRPSGIPERFSGSNSGHTATLTISGTQAMDEADYYCQAWDSSTGVFGTGTQLTVLSAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 440 - DNA, 660 bp, Homo sapiens
  CDS (1)..(660)
caggctgtgctgactcagccgtcctcagcgtctgggacccccgggcagacggtcaccatctcttgttctgggagcacctccaacatcggaagtcataatgtaaactggtaccaacacctcccaggaacggcccccaaactcctcatctatattaataataagcggccctcaggggtccctgaccggttctctgggtccaagtctggctcctccgcctccctggccatcagtgggctccagtctgaggatgaggctgactattattgtgcagcctgggatgacagcctgagacgtccggttttcggcggagggacccagctcaccgttttaagtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 441 - protein, 220 aa, Homo sapiens
QAVLTQPSSASGTPGQTVTISCSGSTSNIGSHNVNWYQHLPGTAPKLLIYINNKRPSGVPDRFSGSKSGSSASLAISGLQSEDEADYYCAAWDDSLRRPVFGGGTQLTVLSAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 442 - DNA, 663 bp, Homo sapiens
  CDS (1)..(663)
cagtctgccctgactcagcctcgctcagtgcccgggtctcctggacagtcagtcaccatctcctgcactggaaccagcagtgatgttggtggttataactatgtctcctggtaccaacagcacccaggcaaagcccccaaactcatgatttatgatgtcagtaagcggccctcaggggtccctgatcgcttctctggctccaagtctggcaacacggcctccctgaccgtctctgggctccaggctgaggatgaggctgattattactgcagctcatatgcaggcagcaacaattttgtggtattcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 443 - protein, 221 aa, Homo sapiens
QSALTQPRSVPGSPGQSVTISCTGTSSDVGGYNYVSWYQQHPGKAPKLMIYDVSKRPSGVPDRFSGSKSGNTASLTVSGLQAEDEADYYCSSYAGSNNFVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 444 - DNA, 639 bp, Homo sapiens
  CDS (1)..(639)
gacatccagttgacccagtctccgtccttcctgtctgcatctgtaggagacagagtcaccatcacttgccgggccagtcagggcattagaagtcatttagcctggtatcagcagaaagcagggaaagcccctaagctcctgatctatgctgcatccactttgcaaagtggggtcccatcaaggttcagcggcagtggatctgggacagagttcactctcacaatcagcagcctgcagcctgacgattttgcagcttattactgtcaacaacttaatacttacccgatcaccttcggccaagggacacgactggagattaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 445 - protein, 213 aa, Homo sapiens
DIQLTQSPSFLSASVGDRVTITCRASQGIRSHLAWYQQKAGKAPKLLIYAASTLQSGVPSRFSGSGSGTEFTLTISSLQPDDFAAYYCQQLNTYPITFGQGTRLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 446 - DNA, 657 bp, Homo sapiens
  CDS (1)..(657)
gacatccagatgacccagtctccagactccctggctgtgtctctgggcgagagggccaccatcaactgcaagtccagccagagtgttttacacaactccaacaataagaactacttagcttggtaccagcagaaaccaggacagcctcctaagctgctcatttactgggcatctacccgggaatccggggtccctgaccgattcagtggcagcgggtctgggacagatttcactctcaccatcagcagcctgcaggctgaagatgtggcagtttattactgtcagcaatattatggttcaccgtacacttttggccaggggaccaagctggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 447 - protein, 219 aa, Homo sapiens
DIQMTQSPDSLAVSLGERATINCKSSQSVLHNSNNKNYLAWYQQKPGQPPKLLIYWASTRESGVPDRFSGSGSGTDFTLTISSLQAEDVAVYYCQQYYGSPYTFGQGTKLEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 448 - DNA, 660 bp, Homo sapiens
  CDS (1)..(660)
tcctatgtgctgactcagccaccctcagcgtctgggacccccgggcagagggtcaccatctcttgttctggaagctcctccaacatcggaagtaattttgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggtgtgctattcggcggaggcacccagctgaccgtcctcggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 449 - protein, 220 aa, Homo sapiens
SYVLTQPPSASGTPGQRVTISCSGSSSNIGSNFVYWYQQLPGTAPKLLIYRNNQRPSGVPDRFSGSKSGTSASLAISGLRSEDEADYYCAAWDDSLSGVLFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 450 - DNA, 639 bp, Homo sapiens
  CDS (1)..(639)
gacatccagttgacccagtctccttccaccctgtctgcatctgtaggagacagagtcaccatcacttgccgggcaagtcagagcattagcagctatttaaattggtatcagcagaaaccagggaaagcccctaagctcctgatctatgctgcatccagtttgcaaagtggggtcccatcaaggttcagtggcagtggatctgggacagatttcactctcaccatcagcagtctgcaacctgaagattttgcaacttactactgtcaacagagttacagtaccccattcactttcggccctgggaccaaagtggatatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 451 - protein, 213 aa, Homo sapiens
DIQLTQSPSTLSASVGDRVTITCRASQSISSYLNWYQQKPGKAPKLLIYAASSLQSGVPSRFSGSGSGTDFTLTISSLQPEDFATYYCQQSYSTPFTFGPGTKVDIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 452 - DNA, 663 bp, Homo sapiens
  CDS (1)..(663)
cagtctgccctgactcagcctccctccgcgtccgggtctcctggacagtcggtcaccatctcctgcactggaaccagcagtgacgttggtggttataactatgtctcctggtaccaacggcacccaggcaaagcccccaaactcatgatttatgatgtcactgatcggccctcaggggtttctaatcgcttctctggctccaagtctggcaacacggcctccctgaccatctctgggctccaggctgaggacgaggctgattattactgcagctcatatacaagcagcagcacttccgcggttttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 453 - protein, 221 aa, Homo sapiens
QSALTQPPSASGSPGQSVTISCTGTSSDVGGYNYVSWYQRHPGKAPKLMIYDVTDRPSGVSNRFSGSKSGNTASLTISGLQAEDEADYYCSSYTSSSTSAVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 454 - DNA, 639 bp, Homo sapiens
  CDS (1)..(639)
gacatccagttgacccagtctccttccaccctgtctgcatctgtaggagacagagtcaccatcacgtgccgggccagtcagagcattagtagctggttggcctggtatcagcaaaaaccagggaaagcccctaagctcctgatctataaggcgtctagtttagaaacaggggtcccatcaaggttcagcggcagtggatctgggacagatttcactctcaccatcagcagcctgcagcctgaagattttgcaacttactattgtcaacaggccaacagtttcccgctcactttcggcggagggaccaaagtggatatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 455 - protein, 213 aa, Homo sapiens
DIQLTQSPSTLSASVGDRVTITCRASQSISSWLAWYQQKPGKAPKLLIYKASSLETGVPSRFSGSGSGTDFTLTISSLQPEDFATYYCQQANSFPLTFGGGTKVDIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 456 - DNA, 660 bp, Homo sapiens
  CDS (1)..(660)
cagtctgtcgtgacgcagccgccctcagcgtctgggacccccgggcagagggtcaccatctcttgttctggaagcagctccaacatcggaagtaattatgtatactggtaccagcagctcccaggaacggcccccaaactcctcatctataggaataatcagcggccctcaggggtccctgaccgattctctggctccaagtctggcacctcagcctccctggccatcagtgggctccggtccgaggatgaggctgattattactgtgcagcatgggatgacagcctgagtggttgggtgttcggcggaggcacccagctgaccgtcctcggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 457 - protein, 220 aa, Homo sapiens
QSVVTQPPSASGTPGQRVTISCSGSSSNIGSNYVYWYQQLPGTAPKLLIYRNNQRPSGVPDRFSGSKSGTSASLAISGLRSEDEADYYCAAWDDSLSGWVFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 458 - DNA, 663 bp, Homo sapiens
  CDS (1)..(663)
cagtctgtgttgacgcagccgccctcagtgtctggggccccagggcagagggtcaccatctcctgcactgggagcagctccaacatcgggacaggttatgatgtacactggtaccagcagcttccaggaacagcccccaaactcctcatctatggtaacaacaatcggccctcaggggtccctgaccgattctctggctccaagtctggcacctcagcctccctggccatcactggactccaggctgaggatgaggctgattattactgtgcaacatgggatgacagcctgaatggttgggtgttcggcggagggaccaagctgaccgtcccaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 459 - protein, 221 aa, Homo sapiens
QSVLTQPPSVSGAPGQRVTISCTGSSSNIGTGYDVHWYQQLPGTAPKLLIYGNNNRPSGVPDRFSGSKSGTSASLAITGLQAEDEADYYCATWDDSLNGWVFGGGTKLTVPGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 460 - DNA, 648 bp, Homo sapiens
  CDS (1)..(648)
cagtctgtgttgacgcagccgccctcggtgtcagtggccccaggacagacggccaggattacctgtgggggatacaacattggaagaaaaagtgtgcactggtaccagcagaagccaggcctggcccctgtgttggtcgtgtatgataatagcgaccggccctcagggatccctgcgcgattctctggctccaactctgggaacacggccaccctgaccatcagcgggacccaggctatggatgaggctgactattactgtcaggcgtgggacagaggcactgccgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 461 - protein, 216 aa, Homo sapiens
QSVLTQPPSVSVAPGQTARITCGGYNIGRKSVHWYQQKPGLAPVLVVYDNSDRPSGIPARFSGSNSGNTATLTISGTQAMDEADYYCQAWDRGTAVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 462 - DNA, 654 bp, Homo sapiens
  CDS (1)..(654)
caggctgtgctgactcagccgtcctcggtgtcagtggccccaggacagacggccaggattacctgtgggggaaacaacattggaagaaaaagtgtgcactggtaccagcagaagccaggcctggcccctgtgctggtcgtcaatgataatagcgaccggccctcagggatccctgcgcgattctctggctccaactctgggaacacggccaccctgaccatcagcagggtcgaagccggggatgaggccgactattactgtcacgtgtggggtagtagtcgtgaccattatgtcttcggaactgggaccaaggtcaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 463 - protein, 218 aa, Homo sapiens
QAVLTQPSSVSVAPGQTARITCGGNNIGRKSVHWYQQKPGLAPVLVVNDNSDRPSGIPARFSGSNSGNTATLTISRVEAGDEADYYCHVWGSSRDHYVFGTGTKVTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 464 - DNA, 660 bp, Homo sapiens
  CDS (1)..(660)
cagtctgccctgactcagcctccctccgcgtccgggtctcctggacagtcagtcaccatctcctgcactggaaccagcagtgacgttggtggttataactttgtctcctggtaccaacagcacccaggcaaagcccccaaactcatgatttatgaggtcagtaatcggccctcgggggtccctgatcgcttctctggctccaagtctggcaacacggcctccctgaccgtctctgggctccaggctgaggatgaggctgattattactgcagctcatatgcaggcaacaacaatttggcgttcggcggaggcacccagctgaccgtcctcggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 465 - protein, 220 aa, Homo sapiens
QSALTQPPSASGSPGQSVTISCTGTSSDVGGYNFVSWYQQHPGKAPKLMIYEVSNRPSGVPDRFSGSKSGNTASLTVSGLQAEDEADYYCSSYAGNNNLAFGGGTQLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 466 - DNA, 654 bp, Homo sapiens
  CDS (1)..(654)
tcttctgagctgactcaggaccctgctgagtctgtggccttgggacagacagtcaagatcacatgccaaggagacagtctcagaaggtattatgcaagttggtaccagcagaagccaggacaggcccctgttcttgtcatctatggcaaaaacaaccggccctcagggatcccagaccgattctctggctccaggtcaggaaacacagcttccttgaccataactggggctcaggcggaagatgaggctgtctattactgtaactcccgggacagcagtggtaactctgtggtcttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 467 - protein, 218 aa, Homo sapiens
SSELTQDPAESVALGQTVKITCQGDSLRRYYASWYQQKPGQAPVLVIYGKNNRPSGIPDRFSGSRSGNTASLTITGAQAEDEAVYYCNSRDSSGNSVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 468 - DNA, 642 bp, Homo sapiens
  CDS (1)..(642)
gaaattgtgttgacacagtctccaggcaccctgtctttgtctccaggggaaagagccaccctctcctgcagggccagtcagagtgttagcagcagctacttagcctggtaccagcagaaacctggccaggctcccaggctcctcatctatggtgcatccagcagggccactggcatcccagacaggttcagtggcagtgggtctgggacagacttcactctcaccatcagcagactggagcctgaagattttgcagtgtattactgtcagcaatatggtaggtcacctctcactttcggcggagggaccaaggtggagatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 469 - protein, 214 aa, Homo sapiens
EIVLTQSPGTLSLSPGERATLSCRASQSVSSSYLAWYQQKPGQAPRLLIYGASSRATGIPDRFSGSGSGTDFTLTISRLEPEDFAVYYCQQYGRSPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 470 - DNA, 666 bp, Homo sapiens
  CDS (1)..(666)
cagtctgccctgactcagcctcgctcagtgtccgggtctcctggacagtcagtcaccatctcctgcactggaaccagcagtgatgttggtggttataactatgtctcctggtaccaacaacacccaggcaaagcccccaaactcatgatttatgatgtcagtaatcggccctcaggggtttctaatcgcttctctggctccaagtctggcaacacggcctccctgaccatctctgggctccaggctgaggacgaggctgagtttcactgcagctcatacagaagcagcggcgcttcccctgtggttttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 471 - protein, 222 aa, Homo sapiens
QSALTQPRSVSGSPGQSVTISCTGTSSDVGGYNYVSWYQQHPGKAPKLMIYDVSNRPSGVSNRFSGSKSGNTASLTISGLQAEDEAEFHCSSYRSSGASPVVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 472 - DNA, 663 bp, Homo sapiens
  CDS (1)..(663)
cagtctgccctgactcagcctccctccgcgtccgggtctcctggacagtcagtcaccatctcctgcactggaaccagcagtgacattggtggttataactatgtctcctggtaccaacagcacccaggcaaagcccccaaactcatgatttatgaggtcagtaatcggcccccaggggtttctaatcgcttctctggctccaagtctggcaacacggcctccctgaccatctctgggctccaggctgaggacgaggctgattattactgcagctcatactcaaccaccaccacccgagtgatattcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 473 - protein, 221 aa, Homo sapiens
QSALTQPPSASGSPGQSVTISCTGTSSDIGGYNYVSWYQQHPGKAPKLMIYEVSNRPPGVSNRFSGSKSGNTASLTISGLQAEDEADYYCSSYSTTTTRVIFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 474 - DNA, 660 bp, Homo sapiens
  CDS (1)..(660)
cagtctgccctgactcagcctccctccgcgtccgggtctcctggacagtcagtcaccatctcctgcactggaaccagcagtgacgttggtggttataactatgtctcctggtaccaacaactgccagggaaagcccccaaactattgatttatgatgtcaataatcggccgtctggggtctctaatcgcttctctggctccaagtcgggaaacacggcctccctgaccatctctgggctccaggctgaggacgaggctgagtattactgcggctcaagtgtaggcagcagactaaggattttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 475 - protein, 220 aa, Homo sapiens
QSALTQPPSASGSPGQSVTISCTGTSSDVGGYNYVSWYQQLPGKAPKLLIYDVNNRPSGVSNRFSGSKSGNTASLTISGLQAEDEAEYYCGSSVGSRLRIFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 476 - DNA, 660 bp, Homo sapiens
  CDS (1)..(660)
cagtctgccctgactcagcctccctccgcgtccgggtctcctggacagtcagtcaccatctcctgcactggaaccagcactgacgttggtggttataactatgtctcctggtaccaacatcacccaggcaaagcccccaaactcgtgatttatggggtcagtaagcggccctcaagggtccctgatcgcttctctggctccaagtctggcaacacggcctccctgaccgtctctgggctccaggctgaggatgaggctgattattactgcagctcatatgcaggcagcaacaatttggtgttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 477 - protein, 220 aa, Homo sapiens
QSALTQPPSASGSPGQSVTISCTGTSTDVGGYNYVSWYQHHPGKAPKLVIYGVSKRPSRVPDRFSGSKSGNTASLTVSGLQAEDEADYYCSSYAGSNNLVFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 478 - DNA, 654 bp, Homo sapiens
  CDS (1)..(654)
gatgttgtgatgactcagtctccactctccctgcccgtcacccctggagagccggcctccatctcctgcaggtctagtcagagcctccggcatagaaatggaaacaactatttggattggtacctgcagaagccagggcagtctccacagctcctgatctatttgggttctaatcgggcctccggggtccctgacaggttcagtggcagtggatcaggcacagattttacactgaaaatcagcagagtggaggctgaggatgttggaatttattactgcatgcaagctctacaaactcctctcactttcggcggagggaccaaggtggaaatcaaacgtgcggccgcacccagcgtgttcatcttccccccctccgacgagcagctgaagagcggcaccgccagcgtggtgtgcctgctgaacaacttctacccccgggaggccaaggtgcagtggaaggtggacaacgccctgcagagcggcaacagccaggagagcgtgaccgagcaggacagcaaggactccacctacagcctgagcagcaccctcaccctgagcaaggccgactacgagaagcacaaggtgtacgcctgcgaggtgacccaccagggcctgagcagccccgtgaccaagagcttcaaccggggcgagtgt

SEQ ID NO: 479 - protein, 218 aa, Homo sapiens
DVVMTQSPLSLPVTPGEPASISCRSSQSLRHRNGNNYLDWYLQKPGQSPQLLIYLGSNRASGVPDRFSGSGSGTDFTLKISRVEAEDVGIYYCMQALQTPLTFGGGTKVEIKRAAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 480 - DNA, 660 bp, Homo sapiens
  CDS (1)..(660)
cagtctgtcgtgacgcagccgccctcagtgtctggggccccagggcagagggtcaccatctcctgcactgggagcagctccaacatcggggcaggttatgatgtacactggtaccagcagcttccaggaacagcccccaaactcctcatctatggtaacagcaatcggccctcaggggtccctgaccgattctctggctccaaatctggcacctcagcctccctggccatcactgggctccaggctgaggatgaggctgattattactgccagtcctctgacagcagcctgaatattttgttcggcggagggaccaagctgaccgtcctaggtgcggccgcaggccagcccaaggccgctcccagcgtgaccctgttccccccctcctccgaggagctgcaggccaacaaggccaccctggtgtgcctcatcagcgacttctaccctggcgccgtgaccgtggcctggaaggccgacagcagccccgtgaaggccggcgtggagaccaccacccccagcaagcagagcaacaacaagtacgccgccagcagctacctgagcctcacccccgagcagtggaagagccaccggagctacagctgccaggtgacccacgagggcagcaccgtggagaagaccgtggcccccaccgagtgcagc

SEQ ID NO: 481 - protein, 220 aa, Homo sapiens
QSVVTQPPSVSGAPGQRVTISCTGSSSNIGAGYDVHWYQQLPGTAPKLLIYGNSNRPSGVPDRFSGSKSGTSASLAITGLQAEDEADYYCQSSDSSLNILFGGGTKLTVLGAAAGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

The invention claimed is:

1. A human monoclonal antibody comprising a heavy chain comprising amino acid sequence SEQ ID NO: 421 and a light chain comprising amino acid sequence SEQ ID NO: 465, wherein the human monoclonal antibody has opsonic phagocytic killing activity against at least one strain of each of at least two different *Enterococcus* species and against at least one strain of *Staphylococcus aureus*.

2. The human monoclonal antibody according to claim 1, characterized in that the *Enterococcus* species comprise *E. faecalis* and *E. faecium*.

3. An immunoconjugate comprising:
the human monoclonal antibody of claim 1, and
at least one tag.

4. A pharmaceutical composition comprising:
the human monoclonal antibody of claim 1, and
at least one pharmaceutically acceptable excipient.

5. A pharmaceutical composition according to claim 4 further comprising at least one other therapeutic agent.

6. An immunoconjugate comprising the human monoclonal antibody of claim 2, and at least one tag.

7. A method of producing a human monoclonal antibody, wherein the method comprises the steps of:
a) culturing a host cell comprising at least one vector that comprises at least one nucleic acid molecule encoding the human monoclonal antibody of claim 1 under conditions conducive to the expression of the human monoclonal antibody
so as to express said human monoclonal antibody.

8. The method according to claim 7, further comprising:
b) recovering the expressed human monoclonal antibody.

9. An isolated human binding molecule comprising:
a heavy chain comprising the amino acid sequence of SEQ ID NO: 421, and
a light chain comprising the amino acid sequence of SEQ ID NO: 465.

10. A pharmaceutical composition comprising:
the human binding molecule of claim 9, and
at least one pharmaceutically acceptable excipient.

11. An immunoconjugate comprising the human binding molecule of claim 9, and at least one tag.

* * * * *